US006933363B1

(12) United States Patent
Wang et al.

(10) Patent No.: US 6,933,363 B1
(45) Date of Patent: Aug. 23, 2005

(54) COMPOSITIONS AND METHODS FOR THERAPY AND DIAGNOSIS OF LUNG CANCER

(75) Inventors: Tongtong Wang, Medina, WA (US); Chaitanya S. Bangur, Seattle, WA (US)

(73) Assignee: Corixa Corporation, Seattle, WA (US)

( * ) Notice: Subject to any disclaimer, the term of this patent is extended or adjusted under 35 U.S.C. 154(b) by 0 days.

(21) Appl. No.: 09/519,642

(22) Filed: Mar. 6, 2000

Related U.S. Application Data

(63) Continuation-in-part of application No. 09/476,300, filed on Dec. 30, 1999, which is a continuation-in-part of application No. 09/466,867, filed on Dec. 17, 1999, which is a continuation-in-part of application No. 09/419,356, filed on Oct. 15, 1999, which is a continuation-in-part of application No. 09/346,492, filed on Jun. 30, 1999.

(51) Int. Cl.⁷ .............................................. A61K 38/16
(52) U.S. Cl. ........................................ 530/350; 514/12
(58) Field of Search ................................. 530/300, 350

(56) References Cited

U.S. PATENT DOCUMENTS

| 5,589,579 A | 12/1996 | Torczynski et al. ........ 536/23.1 |
| 2002/0102604 A1 | 8/2002 | Edwards et al. ............. 435/7.1 |
| 2002/0172952 A1 | 11/2002 | Henderson et al. ............ 435/6 |

FOREIGN PATENT DOCUMENTS

| EP | 1033401 A2 | 9/2000 |
| WO | WO 97/33993 | 9/1997 |
| WO | WO 97/49417 | 12/1997 |
| WO | WO 98/31799 | 7/1998 |
| WO | WO 99/20750 | 4/1999 |
| WO | WO 99/38973 | 8/1999 |
| WO | WO 00/21990 | 4/2000 |
| WO | WO 00/22130 | 4/2000 |
| WO | WO 00/55375 | 9/2000 |
| WO | WO 01/42451 | 6/2001 |
| WO | WO 01/51628 | 7/2001 |

OTHER PUBLICATIONS

Database Genenseq, , accession No. AAW31603, 1997.*
Anderson et al. Electrophoresis, 1997, 18, 533–537.*
Gygi et al. Molecular and Cellular Biology, 1999, 19, 1720–1730.*
GenBank Database, Accession No. AAG01401, Aug. 23, 2000.
GenBank Database, Accession No. AAH09538, Oct. 22, 2001.
GenBank Database, Accession No. AF251237, Aug. 23, 2000.
GenBank Database, Accession No. AJ290447, May 5, 2001.
GenBank Database, Accession No. AJ318878, Jan. 14, 2002.
GenBank Database, Accession No. AJ318879, Jan. 14, 2002.
GenBank Database, Accession No. AJ400997, May 5, 2001.
GenBank Database, Accession No. BC009538, Oct. 22, 2001.
GenBank Database, Accession No. CAC38107, May 5, 2001.
GenBank Database, Accession No. CAC38108, May 5, 2001.
GenBank Database, Accession No. CAC82986, Jan. 14, 2002.
GenBank Database, Accession No. CAC82987, Jan. 14, 2002.
GenBank Database, Accession No. NP_065144, Apr. 6, 2003.
GenBank Database, Accession No. XM_010376, Oct. 16, 2001.
GenBank Database, Accession No. XP_010376, Oct. 16, 2001.
Geneseq Accession No. AAC10552, Oct. 6, 2000.
Genseq Database (Derwent), Accession No. AAH64751, Sep. 11, 2001.
Genseq Database (Derwent), Accession No. AAL13744, Dec. 7, 2001.
Genseq Database (Derwent), Accession No. AAL22641, Dec. 7, 2001.
Genseq Database (Derwent), Accession No. AAS37109, Dec. 17, 2001.
EMBL Accession No. AA488696, Jul. 1, 1997.
EMBL Accession No. AW950090, Jun. 7, 2000.
EMBL Accession No. T63732.1, Mar. 5, 1995.
Hillier et al., "Generation and Analysis of 280,000 Human Expressed Sequence Tags," *Genome Research* 6:807–828, 1996.
Zangemeister–Wittke and Stahel, "Novel approaches to the treatment of small–cell lung cancer," *CMLS, Cell. Mol. Life. Sci.* 55(12):1585–1598, Sep. 1999.
Geneseq Accession No. AAC1055, Oct. 6, 2000.
Geneseq Accession No. AAC17098, Oct. 6, 2000.
Geneseq Accession No. AAA42613, Aug. 21, 2000.
Geneseq Accession No. AAX55997, Jul. 15, 1999.
Geneseq Accession No. AAA45936, Aug. 23, 2000.
EMBL Database Accession No. AA948244, May 5, 1998.
EMBL Database Accession No. AA620697, Oct. 16, 1997.
Chen et al., "Isolation and characterizaton of a novel gene expressed in multiple cancers," *Oncogene* 12(4):741–751, Feb. 15, 1996.

(Continued)

*Primary Examiner*—Michael Borin
(74) *Attorney, Agent, or Firm*—Seed IP Law Group

(57) ABSTRACT

Compositions for the therapy and diagnosis of cancer, such as lung cancer, are disclosed. Compositions may comprise cancer-associated L552S polypeptides, for example, as set forth illustratively in SEQ ID NO:786, or portions or variants thereof. Such compositions may be used, for example, in the diagnosis, prevention, and treatment of diseases such as lung cancer.

3 Claims, No Drawings

OTHER PUBLICATIONS

GenBank Accession No. X21973, May 18, 1999.

Güre et al., "Human lung cancer antigens recognized by autologous antibodies: definition of a novel cDNA derived from the tumor suppressor gene locus on chromosome 3p21.3," *Cancer Research* 58(1):1034–1041, Mar. 1, 1998.

Wu et al., "Activation of globin gene expression by cDNAs from induced K562 cells," *Journal of Biological Chemistry* 266(26):17566–17572, Sep. 15, 1991.

Hara et al., "Characterization of cell phenotype by a novel cDNA library subtraction system: expression of CD8 alpha in a mast cell–derivated interleukin–4–dependent cell line," *Blood* 84(1):189–199, Jul. 1, 1994.

EMBL Database, Accession No. B38797, Mar. 4, 2000.

* cited by examiner

COMPOSITIONS AND METHODS FOR THERAPY AND DIAGNOSIS OF LUNG CANCER

REFERENCE TO RELATED APPLICATIONS

This application is a continuation-in-part of U.S. patent application Ser. No. 09/476,300 filed Dec. 30, 1999, which is a continuation-in-part of U.S. patent application Ser. No. 09/466,867, filed Dec. 17, 1999, which is a continuation-in-part of U.S. patent application Ser. No. 09/419,356, filed Oct. 15, 1999, which is a continuation-in-part of U.S. patent application Ser. No. 09/346,492, filed Jun. 30, 1999.

TECHNICAL FIELD

The present invention relates generally to therapy and diagnosis of cancer, such as lung cancer. The invention is more specifically related to polypeptides comprising at least a portion of a lung tumor protein, and to polynucleotides encoding such polypeptides. Such polypeptides and polynucleotides may be used in vaccines and pharmaceutical compositions for prevention and treatment of lung cancer, and for the diagnosis and monitoring of such cancers.

BACKGROUND OF THE INVENTION

Cancer is a significant health problem throughout the world. Although advances have been made in detection and therapy of cancer, no vaccine or other universally successful method for prevention or treatment is currently available. Current therapies, which are generally based on a combination of chemotherapy or surgery and radiation, continue to prove inadequate in many patients.

Lung cancer is the primary cause of cancer death among both men and women in the U.S., with an estimated 172,000 new cases being reported in 1994. The five-year survival rate among all lung cancer patients, regardless of the stage of disease at diagnosis, is only 13%. This contrasts with a five-year survival rate of 46% among cases detected while the disease is still localized. However, only 16% of lung cancers are discovered before the disease has spread.

Early detection is difficult since clinical symptoms are often not seen until the disease has reached an advanced stage. Currently, diagnosis is aided by the use of chest x-rays, analysis of the type of cells contained in sputum and fiberoptic examination of the bronchial passages. Treatment regimens are determined by the type and stage of the cancer, and include surgery, radiation therapy and/or chemotherapy.

In spite of considerable research into therapies for this and other cancers, lung cancer remains difficult to diagnose and treat effectively. Accordingly, there is a need in the art for improved methods for detecting and treating such cancers. The present invention fulfills these needs and further provides other related advantages.

SUMMARY OF THE INVENTION

Briefly stated, the present invention provides compositions and methods for the diagnosis and therapy of cancer, such as lung cancer. In one aspect, the present invention provides polypeptides comprising at least a portion of a lung tumor protein, or a variant thereof. Certain portions and other variants are immunogenic, such that the ability of the variant to react with antigen-specific antisera is not substantially diminished. Within certain embodiments, the polypeptides comprise a sequence that is encoded by a polynucleotide sequence selected from the group consisting of: (a) sequences recited in SEQ ID NO:1–782, 784, 785 and 788; (b) variants of a sequence recited in SEQ ID NO: 1–782, 784, 785 and 788; and (c) complements of a sequence of (a) or (b).

The present invention further provides polynucleotides that encode a polypeptide as described above, or a portion thereof (such as a portion encoding at least 15 amino acid residues of a lung tumor protein), expression vectors comprising such polynucleotides and host cells transformed or transfected with such expression vectors.

Within other aspects, the present invention provides pharmaceutical compositions comprising a polypeptide or polynucleotide as described above and a physiologically acceptable carrier.

Within a related aspect of the present invention, vaccines are provided. Such vaccines comprise a polypeptide or polynucleotide as described above and an immunostimulant.

The present invention further provides pharmaceutical compositions that comprise: (a) an antibody or antigen-binding fragment thereof that specifically binds to a lung tumor protein; and (b) a physiologically acceptable carrier.

Within further aspects, the present invention provides pharmaceutical compositions comprising: (a) an antigen presenting cell that expresses a polypeptide as described above and (b) a pharmaceutically acceptable carrier or excipient. Antigen presenting cells include dendritic cells, macrophages and B cells.

Within related aspects, vaccines for prophylactic and/or therapeutic use are provided that comprise: (a) an antigen presenting cell that expresses a polypeptide as described above; and (b) an immunostimulant.

The present invention further provides fusion proteins that comprise at least one polypeptide disclosed herein, as well as polynucleotides encoding such fusion proteins.

Within related aspects, pharmaceutical compositions comprising a fusion protein, or a polynucleotide encoding such a fusion protein, in combination with a physiologically acceptable carrier are provided.

Vaccines are further provided that comprise a fusion protein, or a polynucleotide encoding a fusion protein, in combination with an immunostimulant.

Within other aspects, the present invention provides methods for inhibiting the development of a cancer in a patient, comprising administering to a patient a pharmaceutical composition or vaccine as recited above.

The present invention further provides methods for removing tumor cells from a biological sample, comprising contacting a biological sample with T cells that specifically react with a lung tumor protein, wherein the step of contacting is performed under conditions and for a time sufficient to permit the removal of cells expressing the protein from the sample.

Within related aspects, methods are provided for inhibiting the development of a cancer in a patient, comprising administering to a patient a biological sample treated as described above.

Methods are further provided for stimulating and/or expanding T cells specific for a lung tumor protein, comprising contacting T cells under conditions and for a time sufficient to permit the stimulation and/or expansion of the T cells, with one or more of: (i) a polypeptide as described above; (ii) a polynucleotide encoding such a polypeptide; and (iii) an antigen presenting cell that expresses such a polypeptide. Isolated T cell populations comprising T cells prepared as described above are also provided.

Within further aspects, the present invention provides methods for inhibiting the development of a cancer in a patient, comprising administering to a patient an effective amount of a T cell population as described above.

The present invention further provides methods for inhibiting the development of a cancer in a patient, comprising the steps of: (a) incubating $CD4^+$ and/or $CD8^+$ T cells isolated from a patient with one or more of: (i) a polypeptide comprising at least an immunogenic portion of a lung tumor protein; (ii) a polynucleotide encoding such a polypeptide; and (iii) an antigen-presenting cell that expressed such a polypeptide; and (b) administering to the patient an effective amount of the proliferated T cells, and thereby inhibiting the development of a cancer in the patient. Proliferated cells may, but need not, be cloned prior to administration to the patient.

Within further aspects, the present invention provides methods for determining the presence or absence of a cancer in a patient, comprising: (a) contacting a biological sample obtained from a patient with a binding agent that binds to a polypeptide as recited above; (b) detecting in the sample an amount of polypeptide that binds to the binding agent; and (c) comparing the amount of polypeptide with a predetermined cut-off value, and therefrom determining the presence or absence of a cancer in the patient. Within preferred embodiments, the binding agent is an antibody, more preferably a monoclonal antibody. The cancer may be a lung cancer.

The present invention also provides, within other aspects, methods for monitoring the progression of a cancer in a patient. Such methods comprise the steps of: (a) contacting a biological sample obtained from a patient at a first point in time with a binding agent that binds to a polypeptide as recited above; (b) detecting in the sample an amount of polypeptide that binds to the binding agent; (c) repeating steps (a) and (b) using a biological sample obtained from the patient at a subsequent point in time; and (d) comparing the amount of polypeptide detected in step (c) with the amount detected in step (b) and therefrom monitoring the progression of the cancer in the patient.

The present invention further provides, within other aspects, methods for determining the presence or absence of a cancer in a patient, comprising the steps of: (a) contacting a biological sample obtained from a patient with an oligonucleotide that hybridizes to a polynucleotide that encodes a lung tumor protein; (b) detecting in the sample a level of a polynucleotide, preferably mRNA, that hybridizes to the oligonucleotide; and (c) comparing the level of polynucleotide that hybridizes to the oligonucleotide with a predetermined cut-off value, and therefrom determining the presence or absence of a cancer in the patient. Within certain embodiments, the amount of mRNA is detected via polymerase chain reaction using, for example, at least one oligonucleotide primer that hybridizes to a polynucleotide encoding a polypeptide as recited above, or a complement of such a polynucleotide. Within other embodiments, the amount of mRNA is detected using a hybridization technique, employing an oligonucleotide probe that hybridizes to a polynucleotide that encodes a polypeptide as recited above, or a complement of such a polynucleotide.

In related aspects, methods are provided for monitoring the progression of a cancer in a patient, comprising the steps of: (a) contacting a biological sample obtained from a patient with an oligonucleotide that hybridizes to a polynucleotide that encodes a lung tumor protein; (b) detecting in the sample an amount of a polynucleotide that hybridizes to the oligonucleotide; (c) repeating steps (a) and (b) using a biological sample obtained from the patient at a subsequent point in time; and (d) comparing the amount of polynucleotide detected in step (c) with the amount detected in step (b) and therefrom monitoring the progression of the cancer in the patient.

Within further aspects, the present invention provides antibodies, such as monoclonal antibodies, that bind to a polypeptide as described above, as well as diagnostic kits comprising such antibodies. Diagnostic kits comprising one or more oligonucleotide probes or primers as described above are also provided.

These and other aspects of the present invention will become apparent upon reference to the following detailed description. All references disclosed herein are hereby incorporated by reference in their entirety as if each was incorporated individually.

SEQUENCE IDENTIFIERS

SEQ ID NO: 1 is the determined cDNA sequence for clone #19038, also referred to as L845P.

SEQ ID NO: 2 is the determined cDNA sequence for clone #19036.

SEQ ID NO: 3 is the determined cDNA sequence for clone #19034.

SEQ ID NO: 4 is the determined cDNA sequence for clone #19033.

SEQ ID NO: 5 is the determined cDNA sequence for clone #19032.

SEQ ID NO: 6 is the determined cDNA sequence for clone #19030, also referred to as L559S.

SEQ ID NO: 7 is the determined cDNA sequence for clone #19029.

SEQ ID NO: 8 is the determined cDNA sequence for clone #19025.

SEQ ID NO: 9 is the determined cDNA sequence for clone #19023.

SEQ ID NO: 10 is the determined cDNA sequence for clone #18929.

SEQ ID NO: 11 is the determined cDNA sequence for clone #19010.

SEQ ID NO: 12 is the determined cDNA sequence for clone #19009.

SEQ ID NO: 13 is the determined cDNA sequence for clones #19005, 19007, 19016 and 19017.

SEQ ID NO: 14 is the determined cDNA sequence for clone #19004.

SEQ ID NO: 15 is the determined cDNA sequence for clones #19002 and 18965.

SEQ ID NO: 16 is the determined cDNA sequence for clone #18998.

SEQ ID NO: 17 is the determined cDNA sequence for clone #18997.

SEQ ID NO: 18 is the determined cDNA sequence for clone #18996.

SEQ ID NO: 19 is the determined cDNA sequence for clone #18995.

SEQ ID NO: 20 is the determined cDNA sequence for clone #18994, also known as L846P.

SEQ ID NO: 21 is the determined cDNA sequence for clone #18992.

SEQ ID NO: 22 is the determined cDNA sequence for clone #18991.

SEQ ID NO: 23 is the determined cDNA sequence for clone #18990, also referred to as clone #20111.

SEQ ID NO: 24 is the determined cDNA sequence for clone #18987.

SEQ ID NO: 25 is the determined cDNA sequence for clone #18985, also referred as L839P.

SEQ ID NO: 26 is the determined cDNA sequence for clone #18984, also referred to as L847P.

SEQ ID NO: 27 is the determined cDNA sequence for clone #18983.

SEQ ID NO: 28 is the determined cDNA sequence for clones #18976 and 18980.

SEQ ID NO: 29 is the determined cDNA sequence for clone #18975.

SEQ ID NO: 30 is the determined cDNA sequence for clone #18974.

SEQ ID NO: 31 is the determined cDNA sequence for clone #18973.

SEQ ID NO: 32 is the determined cDNA sequence for clone #18972.

SEQ ID NO: 33 is the determined cDNA sequence for clone #18971, also referred to as L801P.

SEQ ID NO: 34 is the determined cDNA sequence for clone #18970.

SEQ ID NO: 35 is the determined cDNA sequence for clone #18966.

SEQ ID NO: 36 is the determined cDNA sequence for clones #18964, 18968 and 19039.

SEQ ID NO: 37 is the determined cDNA sequence for clone #18960.

SEQ ID NO: 38 is the determined cDNA sequence for clone #18959.

SEQ ID NO: 39 is the determined cDNA sequence for clones #18958 and 18982.

SEQ ID NO: 40 is the determined cDNA sequence for clones #18956 and 19015.

SEQ ID NO: 41 is the determined cDNA sequence for clone #18954, also referred to L848P.

SEQ ID NO: 42 is the determined cDNA sequence for clone #18951.

SEQ ID NO: 43 is the determined cDNA sequence for clone #18950.

SEQ ID NO: 44 is the determined cDNA sequence for clones #18949 and 19024, also referred to as L844P.

SEQ ID NO: 45 is the determined cDNA sequence for clone #18948.

SEQ ID NO: 46 is the determined cDNA sequence for clone #18947, also referred to as L840P.

SEQ ID NO: 47 is the determined cDNA sequence for clones #18946, 18953, 18969 and 19027.

SEQ ID NO: 48 is the determined cDNA sequence for clone #18942.

SEQ ID NO: 49 is the determined cDNA sequence for clone #18940, 18962, 18963, 19006, 19008, 19000, and 19031.

SEQ ID NO: 50 is the determined cDNA sequence for clone #18939.

SEQ ID NO: 51 is the determined cDNA sequence for clones #18938 and 18952.

SEQ ID NO: 52 is the determined cDNA sequence for clone #18938.

SEQ ID NO: 53 is the determined cDNA sequence for clone #18937.

SEQ ID NO: 54 is the determined cDNA sequence for clones #18934, 18935, 18993 and 19022, also referred to as L548S.

SEQ ID NO: 55 is the determined cDNA sequence for clone #18932.

SEQ ID NO: 56 is the determined cDNA sequence for clones #18931 and 18936.

SEQ ID NO: 57 is the determined cDNA sequence for clone #18930.

SEQ ID NO: 58 is the determined cDNA sequence for clone #19014, also referred to as L773P.

SEQ ID NO: 59 is the determined cDNA sequence for clone #19127.

SEQ ID NO: 60 is the determined cDNA sequence for clones #19057 and 19064.

SEQ ID NO: 61 is the determined cDNA sequence for clone #19122.

SEQ ID NO: 62 is the determined cDNA sequence for clones #19120 and 18121.

SEQ ID NO: 63 is the determined cDNA sequence for clone #19118.

SEQ ID NO: 64 is the determined cDNA sequence for clone #19117.

SEQ ID NO: 65 is the determined cDNA sequence for clone #19116.

SEQ ID NO: 66 is the determined cDNA sequence for clone #19114.

SEQ ID NO: 67 is the determined cDNA sequence for clone #19112, also known as L561S.

SEQ ID NO: 68 is the determined cDNA sequence for clone #19110.

SEQ ID NO: 69 is the determined cDNA sequence for clone #19107, also referred to as L552S.

SEQ ID NO: 70 is the determined cDNA sequence for clone #19106, also referred to as L547S.

SEQ ID NO: 71 is the determined cDNA sequence for clones #19105 and 19111.

SEQ ID NO: 72 is the determined cDNA sequence for clone #19099.

SEQ ID NO: 73 is the determined cDNA sequence for clones #19095, 19104 and 19125, also referred to as L549S.

SEQ ID NO: 74 is the determined cDNA sequence for clone #19094.

SEQ ID NO: 75 is the determined cDNA sequence for clones #19089 and 19101.

SEQ ID NO: 76 is the determined cDNA sequence for clone #19088.

SEQ ID NO: 77 is the determined cDNA sequence for clones #19087, 19092, 19096, 19100 and 19119.

SEQ ID NO: 78 is the determined cDNA sequence for clone #19086.

SEQ ID NO: 79 is the determined cDNA sequence for clone #19085, also referred to as L550S.

SEQ ID NO: 80 is the determined cDNA sequence for clone #19084, also referred to as clone #19079.

SEQ ID NO: 81 is the determined cDNA sequence for clone #19082.

SEQ ID NO: 82 is the determined cDNA sequence for clone #19080.

SEQ ID NO: 83 is the determined cDNA sequence for clone #19077.

SEQ ID NO: 84 is the determined cDNA sequence for clone #19076, also referred to as L550S.

SEQ ID NO: 85 is the determined cDNA sequence for clone #19074, also referred to as clone #20102.

SEQ ID NO: 86 is the determined cDNA sequence for clone #19073, also referred to as L560S.

SEQ ID NO: 87 is the determined cDNA sequence for clones #19072 and 19115.

SEQ ID NO: 88 is the determined cDNA sequence for clone #19071.

SEQ ID NO: 89 is the determined cDNA sequence for clone #19070.

SEQ ID NO: 90 is the determined cDNA sequence for clone #19069.

SEQ ID NO: 91 is the determined cDNA sequence for clone #19068, also referred to L563S.

SEQ ID NO: 92 is the determined cDNA sequence for clone #19066.

SEQ ID NO: 93 is the determined cDNA sequence for clone #19065.

SEQ ID NO: 94 is the determined cDNA sequence for clone #19063.

SEQ ID NO: 95 is the determined cDNA sequence for clones #19061, 19081, 19108 and 19109.

SEQ ID NO: 96 is the determined cDNA sequence for clones #19060, 19067 and 19083, also referred to as L548S.

SEQ ID NO: 97 is the determined cDNA sequence for clones #19059 and 19062.

SEQ ID NO: 98 is the determined cDNA sequence for clone #19058.

SEQ ID NO: 99 is the determined cDNA sequence for clone #19124.

SEQ ID NO: 100 is the determined cDNA sequence for clone #18929.

SEQ ID NO: 101 is the determined cDNA sequence for clone #18422.

SEQ ID NO: 102 is the determined cDNA sequence for clone #18425.

SEQ ID NO: 103 is the determined cDNA sequence for clone #18431.

SEQ ID NO: 104 is the determined cDNA sequence for clone #18433.

SEQ ID NO: 105 is the determined cDNA sequence for clone #18444.

SEQ ID NO: 106 is the determined cDNA sequence for clone #18449.

SEQ ID NO: 107 is the determined cDNA sequence for clone #18451.

SEQ ID NO: 108 is the determined cDNA sequence for clone #18452.

SEQ ID NO: 109 is the determined cDNA sequence for clone #18455.

SEQ ID NO: 110 is the determined cDNA sequence for clone #18457.

SEQ ID NO: 111 is the determined cDNA sequence for clone #18466.

SEQ ID NO: 112 is the determined cDNA sequence for clone #18468.

SEQ ID NO: 113 is the determined cDNA sequence for clone #18471.

SEQ ID NO: 114 is the determined cDNA sequence for clone #18475.

SEQ ID NO: 115 is the determined cDNA sequence for clone #18476.

SEQ ID NO: 116 is the determined cDNA sequence for clone #18477.

SEQ ID NO: 117 is the determined cDNA sequence for clone #20631.

SEQ ID NO: 118 is the determined cDNA sequence for clone #20634.

SEQ ID NO: 119 is the determined cDNA sequence for clone #20635.

SEQ ID NO: 120 is the determined cDNA sequence for clone #20637.

SEQ ID NO: 121 is the determined cDNA sequence for clone #20638.

SEQ ID NO: 122 is the determined cDNA sequence for clone #20643.

SEQ ID NO: 123 is the determined cDNA sequence for clone #20652.

SEQ ID NO: 124 is the determined cDNA sequence for clone #20653.

SEQ ID NO: 125 is the determined cDNA sequence for clone #20657.

SEQ ID NO: 126 is the determined cDNA sequence for clone #20658.

SEQ ID NO: 127 is the determined cDNA sequence for clone #20660.

SEQ ID NO: 128 is the determined cDNA sequence for clone #20661.

SEQ ID NO: 129 is the determined cDNA sequence for clone #20663.

SEQ ID NO: 130 is the determined cDNA sequence for clone #20665.

SEQ ID NO: 131 is the determined cDNA sequence for clone #20670.

SEQ ID NO: 132 is the determined cDNA sequence for clone #20671.

SEQ ID NO: 133 is the determined cDNA sequence for clone #20672.

SEQ ID NO: 134 is the determined cDNA sequence for clone #20675.

SEQ ID NO: 135 is the determined cDNA sequence for clone #20679.

SEQ ID NO: 136 is the determined cDNA sequence for clone #20681.

SEQ ID NO: 137 is the determined cDNA sequence for clone #20682.

SEQ ID NO: 138 is the determined cDNA sequence for clone #20684.

SEQ ID NO: 139 is the determined cDNA sequence for clone #20685.

SEQ ID NO: 140 is the determined cDNA sequence for clone #20689.

SEQ ID NO: 141 is the determined cDNA sequence for clone #20699.

SEQ ID NO: 142 is the determined cDNA sequence for clone #20701.

SEQ ID NO: 143 is the determined cDNA sequence for clone #20702.

SEQ ID NO: 144 is the determined cDNA sequence for clone #20708.

SEQ ID NO: 145 is the determined cDNA sequence for clone #20715.

SEQ ID NO: 146 is the determined cDNA sequence for clone #20716.

SEQ ID NO: 147 is the determined cDNA sequence for clone #20719.

SEQ ID NO: 148 is the determined cDNA sequence for clone #19129.

SEQ ID NO: 149 is the determined cDNA sequence for clone #19131.1.

SEQ ID NO: 150 is the determined cDNA sequence for clone #19132.2.

SEQ ID NO: 151 is the determined cDNA sequence for clone #19133.

SEQ ID NO: 152 is the determined cDNA sequence for clone #19134.2.

SEQ ID NO: 153 is the determined cDNA sequence for clone #19135.2.

SEQ ID NO: 154 is the determined cDNA sequence for clone #19137.

SEQ ID NO: 155 is a first determined cDNA sequence for clone #19138.1.

SEQ ID NO: 156 is a second determined cDNA sequence for clone #19138.2.

SEQ ID NO: 157 is the determined cDNA sequence for clone #19139.

SEQ ID NO: 158 is a first determined cDNA sequence for clone #19140.1.

SEQ ID NO: 159 is a second determined cDNA sequence for clone #19140.2.

SEQ ID NO: 160 is the determined cDNA sequence for clone #19141.

SEQ ID NO: 161 is the determined cDNA sequence for clone #19143.

SEQ ID NO: 162 is the determined cDNA sequence for clone #19144.

SEQ ID NO: 163 is a first determined cDNA sequence for clone #19145.1.

SEQ ID NO: 164 is a second determined cDNA sequence for clone #19145.2.

SEQ ID NO: 165 is the determined cDNA sequence for clone #19146.

SEQ ID NO: 166 is the determined cDNA sequence for clone #19149.1.

SEQ ID NO: 167 is the determined cDNA sequence for clone #19152.

SEQ ID NO: 168 is a first determined cDNA sequence for clone #19153.1.

SEQ ID NO: 169 is a second determined cDNA sequence for clone #19153.2.

SEQ ID NO: 170 is the determined cDNA sequence for clone #19155.

SEQ ID NO: 171 is the determined cDNA sequence for clone #19157.

SEQ ID NO: 172 is the determined cDNA sequence for clone #19159.

SEQ ID NO: 173 is the determined cDNA sequence for clone #19160.

SEQ ID NO: 174 is a first determined cDNA sequence for clone #19161.1.

SEQ ID NO: 175 is a second determined cDNA sequence for clone #19161.2.

SEQ ID NO: 176 is the determined cDNA sequence for clone #19162.1.

SEQ ID NO: 177 is the determined cDNA sequence for clone #19166.

SEQ ID NO: 178 is the determined cDNA sequence for clone #19169.

SEQ ID NO: 179 is the determined cDNA sequence for clone #19171.

SEQ ID NO: 180 is a first determined cDNA sequence for clone #19173.1.

SEQ ID NO: 181 is a second determined cDNA sequence for clone #19173.2.

SEQ ID NO: 182 is the determined cDNA sequence for clone #19174.1.

SEQ ID NO: 183 is the determined cDNA sequence for clone #19175.

SEQ ID NO: 184 is the determined cDNA sequence for clone #19177.

SEQ ID NO: 185 is the determined cDNA sequence for clone #19178.

SEQ ID NO: 186 is the determined cDNA sequence for clone #19179.1.

SEQ ID NO: 187 is the determined cDNA sequence for clone #19179.2.

SEQ ID NO: 188 is the determined cDNA sequence for clone #19180.

SEQ ID NO: 189 is a first determined cDNA sequence for clone #19182.1.

SEQ ID NO: 190 is a second determined cDNA sequence for clone #19182.2.

SEQ ID NO: 191 is the determined cDNA sequence for clone #19183.1.

SEQ ID NO: 192 is the determined cDNA sequence for clone #19185.1.

SEQ ID NO: 193 is the determined cDNA sequence for clone #19187.

SEQ ID NO: 194 is the determined cDNA sequence for clone #19188.

SEQ ID NO: 195 is the determined cDNA sequence for clone #19190.

SEQ ID NO: 196 is the determined cDNA sequence for clone #19191.

SEQ ID NO: 197 is the determined cDNA sequence for clone #19192.

SEQ ID NO: 198 is the determined cDNA sequence for clone #19193.

SEQ ID NO: 199 is a first determined cDNA sequence for clone #19194.1.

SEQ ID NO: 200 is a second determined cDNA sequence for clone #19194.2.

SEQ ID NO: 201 is the determined cDNA sequence for clone #19197.

SEQ ID NO: 202 is a first determined cDNA sequence for clone #19200.1.

SEQ ID NO: 203 is a second determined cDNA sequence for clone #19200.2.

SEQ ID NO: 204 is the determined cDNA sequence for clone #19202.

SEQ ID NO: 205 is a first determined cDNA sequence for clone #19204.1.

SEQ ID NO: 206 is a second determined cDNA sequence for clone #19204.2.

SEQ ID NO: 207 is the determined cDNA sequence for clone #19205.

SEQ ID NO: 208 is a first determined cDNA sequence for clone #19206.1.

SEQ ID NO: 209 is a second determined cDNA sequence for clone #19206.2.

SEQ ID NO: 210 is the determined cDNA sequence for clone #19207.

SEQ ID NO: 211 is the determined cDNA sequence for clone #19208.

SEQ ID NO: 212 is a first determined cDNA sequence for clone #19211.1.

SEQ ID NO: 213 is a second determined cDNA sequence for clone #19211.2.

SEQ ID NO: 214 is a first determined cDNA sequence for clone #19214.1.

SEQ ID NO: 215 is a second determined cDNA sequence for clone #19214.2.

SEQ ID NO: 216 is the determined cDNA sequence for clone #19215.

SEQ ID NO: 217 is a first determined cDNA sequence for clone #19217.1.

SEQ ID NO: 218 is a second determined cDNA sequence for clone #19217.2.

SEQ ID NO: 219 is a first determined cDNA sequence for clone #19218.1.

SEQ ID NO: 220 is a second determined cDNA sequence for clone #19218.2.

SEQ ID NO: 221 is a first determined cDNA sequence for clone #19220.1.

SEQ ID NO: 222 is a second determined cDNA sequence for clone #19220.2.

SEQ ID NO: 223 is the determined cDNA sequence for clone #22015.

SEQ ID NO: 224 is the determined cDNA sequence for clone #22017.

SEQ ID NO: 225 is the determined cDNA sequence for clone #22019.

SEQ ID NO: 226 is the determined cDNA sequence for clone #22020.

SEQ ID NO: 227 is the determined cDNA sequence for clone #22023.

SEQ ID NO: 228 is the determined cDNA sequence for clone #22026.

SEQ ID NO: 229 is the determined cDNA sequence for clone #22027.

SEQ ID NO: 230 is the determined cDNA sequence for clone #22028.

SEQ ID NO: 231 is the determined cDNA sequence for clone #22032.

SEQ ID NO: 232 is the determined cDNA sequence for clone #22037.

SEQ ID NO: 233 is the determined cDNA sequence for clone #22045.

SEQ ID NO: 234 is the determined cDNA sequence for clone #22048.

SEQ ID NO: 235 is the determined cDNA sequence for clone #22050.

SEQ ID NO: 236 is the determined cDNA sequence for clone #22052.

SEQ ID NO: 237 is the determined cDNA sequence for clone #22053.

SEQ ID NO: 238 is the determined cDNA sequence for clone #22057.

SEQ ID NO: 239 is the determined cDNA sequence for clone #22066.

SEQ ID NO: 240 is the determined cDNA sequence for clone #22077.

SEQ ID NO: 241 is the determined cDNA sequence for clone #22085.

SEQ ID NO: 242 is the determined cDNA sequence for clone #22105.

SEQ ID NO: 243 is the determined cDNA sequence for clone #22108.

SEQ ID NO: 244 is the determined cDNA sequence for clone #22109.

SEQ ID NO: 245 is the determined cDNA sequence for clone #24842.

SEQ ID NO: 246 is the determined cDNA sequence for clone #24843.

SEQ ID NO: 247 is the determined cDNA sequence for clone #24845.

SEQ ID NO: 248 is the determined cDNA sequence for clone #24851.

SEQ ID NO: 249 is the determined cDNA sequence for clone #24852.

SEQ ID NO: 250 is the determined cDNA sequence for clone #24853.

SEQ ID NO: 251 is the determined cDNA sequence for clone #24854.

SEQ ID NO: 252 is the determined cDNA sequence for clone #24855.

SEQ ID NO: 253 is the determined cDNA sequence for clone #24860.

SEQ ID NO: 254 is the determined cDNA sequence for clone #24864.

SEQ ID NO: 255 is the determined cDNA sequence for clone #24866.

SEQ ID NO: 256 is the determined cDNA sequence for clone #24867.

SEQ ID NO: 257 is the determined cDNA sequence for clone #24868.

SEQ ID NO: 258 is the determined cDNA sequence for clone #24869.

SEQ ID NO: 259 is the determined cDNA sequence for clone #24870.

SEQ ID NO: 260 is the determined cDNA sequence for clone #24872.

SEQ ID NO: 261 is the determined cDNA sequence for clone #24873.

SEQ ID NO: 262 is the determined cDNA sequence for clone #24875.

SEQ ID NO: 263 is the determined cDNA sequence for clone #24882.

SEQ ID NO: 264 is the determined cDNA sequence for clone #24885.

SEQ ID NO: 265 is the determined cDNA sequence for clone #24886.

SEQ ID NO: 266 is the determined cDNA sequence for clone #24887.

SEQ ID NO: 267 is the determined cDNA sequence for clone #24888.

SEQ ID NO: 268 is the determined cDNA sequence for clone #24890.

SEQ ID NO: 269 is the determined cDNA sequence for clone #24896.

SEQ ID NO: 270 is the determined cDNA sequence for clone #24897.

SEQ ID NO: 271 is the determined cDNA sequence for clone #24899.

SEQ ID NO: 272 is the determined cDNA sequence for clone #24901.
SEQ ID NO: 273 is the determined cDNA sequence for clone #24902.
SEQ ID NO: 274 is the determined cDNA sequence for clone #24906.
SEQ ID NO: 275 is the determined cDNA sequence for clone #24912.
SEQ ID NO: 276 is the determined cDNA sequence for clone #24913.
SEQ ID NO: 277 is the determined cDNA sequence for clone #24920.
SEQ ID NO: 278 is the determined cDNA sequence for clone #24927.
SEQ ID NO: 279 is the determined cDNA sequence for clone #24930.
SEQ ID NO: 280 is the determined cDNA sequence for clone #26938.
SEQ ID NO: 281 is the determined cDNA sequence for clone #26939.
SEQ ID NO: 282 is the determined cDNA sequence for clone #26943.
SEQ ID NO: 283 is the determined cDNA sequence for clone #26948.
SEQ ID NO: 284 is the determined cDNA sequence for clone #26951.
SEQ ID NO: 285 is the determined cDNA sequence for clone #26955.
SEQ ID NO: 286 is the determined cDNA sequence for clone #26956.
SEQ ID NO: 287 is the determined cDNA sequence for clone #26959.
SEQ ID NO: 288 is the determined cDNA sequence for clone #26961.
SEQ ID NO: 289 is the determined cDNA sequence for clone #26962.
SEQ ID NO: 290 is the determined cDNA sequence for clone #26964.
SEQ ID NO: 291 is the determined cDNA sequence for clone #26966.
SEQ ID NO: 292 is the determined cDNA sequence for clone #26968.
SEQ ID NO: 293 is the determined cDNA sequence for clone #26972.
SEQ ID NO: 294 is the determined cDNA sequence for clone #26973.
SEQ ID NO: 295 is the determined cDNA sequence for clone #26974.
SEQ ID NO: 296 is the determined cDNA sequence for clone #26976.
SEQ ID NO: 297 is the determined cDNA sequence for clone #26977.
SEQ ID NO: 298 is the determined cDNA sequence for clone #26979.
SEQ ID NO: 299 is the determined cDNA sequence for clone #26980.
SEQ ID NO: 300 is the determined cDNA sequence for clone #26981.
SEQ ID NO: 301 is the determined cDNA sequence for clone #26984.
SEQ ID NO: 302 is the determined cDNA sequence for clone #26985.
SEQ ID NO: 303 is the determined cDNA sequence for clone #26986.
SEQ ID NO: 304 is the determined cDNA sequence for clone #26993.
SEQ ID NO: 305 is the determined cDNA sequence for clone #26994.
SEQ ID NO: 306 is the determined cDNA sequence for clone #26995.
SEQ ID NO: 307 is the determined cDNA sequence for clone #27003.
SEQ ID NO: 308 is the determined cDNA sequence for clone #27005.
SEQ ID NO: 309 is the determined cDNA sequence for clone #27010.
SEQ ID NO: 310 is the determined cDNA sequence for clone #27011.
SEQ ID NO: 311 is the determined cDNA sequence for clone #27013.
SEQ ID NO: 312 is the determined cDNA sequence for clone #27016.
SEQ ID NO: 313 is the determined cDNA sequence for clone #27017.
SEQ ID NO: 314 is the determined cDNA sequence for clone #27019.
SEQ ID NO: 315 is the determined cDNA sequence for clone #27028.
SEQ ID NO: 316 is the full-length cDNA sequence for clone #19060.
SEQ ID NO: 317 is the full-length cDNA sequence for clone #18964.
SEQ ID NO: 318 is the full-length cDNA sequence for clone #18929.
SEQ ID NO: 319 is the full-length cDNA sequence for clone #18991.
SEQ ID NO: 320 is the full-length cDNA sequence for clone #18996.
SEQ ID NO: 321 is the full-length cDNA sequence for clone #18966.
SEQ ID NO: 322 is the full-length cDNA sequence for clone #18951.
SEQ ID NO: 323 is the full-length cDNA sequence for clone #18973 (also known as L516S).
SEQ ID NO: 324 is the amino acid sequence for clone #19060.
SEQ ID NO: 325 is the amino acid sequence for clone #19063.
SEQ ID NO: 326 is the amino acid sequence for clone #19077.
SEQ ID NO: 327 is the amino acid sequence for clone #19110.
SEQ ID NO: 328 is the amino acid sequence for clone #19122.
SEQ ID NO: 329 is the amino acid sequence for clone #19118.
SEQ ID NO: 330 is the amino acid sequence for clone #19080.
SEQ ID NO: 331 is the amino acid sequence for clone #19127.
SEQ ID NO: 332 is the amino acid sequence for clone #19117.
SEQ ID NO: 333 is the amino acid sequence for clone #19095, also referred to L549S.

SEQ ID NO: 334 is the amino acid sequence for clone #18964.

SEQ ID NO: 335 is the amino acid sequence for clone #18929.

SEQ ID NO: 336 is the amino acid sequence for clone #18991.

SEQ ID NO: 337 is the amino acid sequence for clone #18996.

SEQ ID NO: 338 is the amino acid sequence for clone #18966.

SEQ ID NO: 339 is the amino acid sequence for clone #18951.

SEQ ID NO: 340 is the amino acid sequence for clone #18973.

SEQ ID NO: 341 is the determined cDNA sequence for clone 26461.

SEQ ID NO: 342 is the determined cDNA sequence for clone 26462.

SEQ ID NO: 343 is the determined cDNA sequence for clone 26463.

SEQ ID NO: 344 is the determined cDNA sequence for clone 26464.

SEQ ID NO: 345 is the determined cDNA sequence for clone 26465.

SEQ ID NO: 346 is the determined cDNA sequence for clone 26466.

SEQ ID NO: 347 is the determined cDNA sequence for clone 26467.

SEQ ID NO: 348 is the determined cDNA sequence for clone 26468.

SEQ ID NO: 349 is the determined cDNA sequence for clone 26469.

SEQ ID NO: 350 is the determined cDNA sequence for clone 26470.

SEQ ID NO: 351 is the determined cDNA sequence for clone 26471.

SEQ ID NO: 352 is the determined cDNA sequence for clone 26472.

SEQ ID NO: 353 is the determined cDNA sequence for clone 26474.

SEQ ID NO: 354 is the determined cDNA sequence for clone 26475.

SEQ ID NO: 355 is the determined cDNA sequence for clone 26476.

SEQ ID NO: 356 is the determined cDNA sequence for clone 26477.

SEQ ID NO: 357 is the determined cDNA sequence for clone 26478.

SEQ ID NO: 358 is the determined cDNA sequence for clone 26479.

SEQ ID NO: 359 is the determined cDNA sequence for clone 26480.

SEQ ID NO: 360 is the determined cDNA sequence for clone 26481.

SEQ ID NO: 361 is the determined cDNA sequence for clone 26482.

SEQ ID NO: 362 is the determined cDNA sequence for clone 26483.

SEQ ID NO: 363 is the determined cDNA sequence for clone 26484.

SEQ ID NO: 364 is the determined cDNA sequence for clone 26485.

SEQ ID NO: 365 is the determined cDNA sequence for clone 26486.

SEQ ID NO: 366 is the determined cDNA sequence for clone 26487.

SEQ ID NO: 367 is the determined cDNA sequence for clone 26488.

SEQ ID NO: 368 is the determined cDNA sequence for clone 26489.

SEQ ID NO: 369 is the determined cDNA sequence for clone 26490.

SEQ ID NO: 370 is the determined cDNA sequence for clone 26491.

SEQ ID NO: 371 is the determined cDNA sequence for clone 26492.

SEQ ID NO: 372 is the determined cDNA sequence for clone 26493.

SEQ ID NO: 373 is the determined cDNA sequence for clone 26494.

SEQ ID NO: 374 is the determined cDNA sequence for clone 26495.

SEQ ID NO: 375 is the determined cDNA sequence for clone 26496.

SEQ ID NO: 376 is the determined cDNA sequence for clone 26497.

SEQ ID NO: 377 is the determined cDNA sequence for clone 26498.

SEQ ID NO: 378 is the determined cDNA sequence for clone 26499.

SEQ ID NO: 379 is the determined cDNA sequence for clone 26500.

SEQ ID NO: 380 is the determined cDNA sequence for clone 26501.

SEQ ID NO: 381 is the determined cDNA sequence for clone 26502.

SEQ ID NO: 382 is the determined cDNA sequence for clone 26503.

SEQ ID NO: 383 is the determined cDNA sequence for clone 26504.

SEQ ID NO: 384 is the determined cDNA sequence for clone 26505.

SEQ ID NO: 385 is the determined cDNA sequence for clone 26506.

SEQ ID NO: 386 is the determined cDNA sequence for clone 26507.

SEQ ID NO: 387 is the determined cDNA sequence for clone 26508.

SEQ ID NO: 388 is the determined cDNA sequence for clone 26509.

SEQ ID NO: 389 is the determined cDNA sequence for clone 26511.

SEQ ID NO: 390 is the determined cDNA sequence for clone 26513.

SEQ ID NO: 391 is the determined cDNA sequence for clone 26514.

SEQ ID NO: 392 is the determined cDNA sequence for clone 26515.

SEQ ID NO: 393 is the determined cDNA sequence for clone 26516.

SEQ ID NO: 394 is the determined cDNA sequence for clone 26517.

SEQ ID NO: 395 is the determined cDNA sequence for clone 26518.

SEQ ID NO: 396 is the determined cDNA sequence for clone 26519.
SEQ ID NO: 397 is the determined cDNA sequence for clone 26520.
SEQ ID NO: 398 is the determined cDNA sequence for clone 26521.
SEQ ID NO: 399 is the determined cDNA sequence for clone 26522.
SEQ ID NO: 400 is the determined cDNA sequence for clone 26523.
SEQ ID NO: 401 is the determined cDNA sequence for clone 26524.
SEQ ID NO: 402 is the determined cDNA sequence for clone 26526.
SEQ ID NO: 403 is the determined cDNA sequence for clone 26527.
SEQ ID NO: 404 is the determined cDNA sequence for clone 26528.
SEQ ID NO: 405 is the determined cDNA sequence for clone 26529.
SEQ ID NO: 406 is the determined cDNA sequence for clone 26530.
SEQ ID NO: 407 is the determined cDNA sequence for clone 26532.
SEQ ID NO: 408 is the determined cDNA sequence for clone 26533.
SEQ ID NO: 409 is the determined cDNA sequence for clone 26534.
SEQ ID NO: 410 is the determined cDNA sequence for clone 26535.
SEQ ID NO: 411 is the determined cDNA sequence for clone 26536.
SEQ ID NO: 412 is the determined cDNA sequence for clone 26537.
SEQ ID NO: 413 is the determined cDNA sequence for clone 26538.
SEQ ID NO: 414 is the determined cDNA sequence for clone 26540.
SEQ ID NO: 415 is the determined cDNA sequence for clone 26541.
SEQ ID NO: 416 is the determined cDNA sequence for clone 26542.
SEQ ID NO: 417 is the determined cDNA sequence for clone 26543.
SEQ ID NO: 418 is the determined cDNA sequence for clone 26544.
SEQ ID NO: 419 is the determined cDNA sequence for clone 26546.
SEQ ID NO: 420 is the determined cDNA sequence for clone 26547.
SEQ ID NO: 421 is the determined cDNA sequence for clone 26548.
SEQ ID NO: 422 is the determined cDNA sequence for clone 26549.
SEQ ID NO: 423 is the determined cDNA sequence for clone 26550.
SEQ ID NO: 424 is the determined cDNA sequence for clone 26551.
SEQ ID NO: 425 is the determined cDNA sequence for clone 26552.
SEQ ID NO: 426 is the determined cDNA sequence for clone 26553.
SEQ ID NO: 427 is the determined cDNA sequence for clone 26554.
SEQ ID NO: 428 is the determined cDNA sequence for clone 26556.
SEQ ID NO: 429 is the determined cDNA sequence for clone 26557.
SEQ ID NO: 430 is the determined cDNA sequence for clone 27631.
SEQ ID NO: 431 is the determined cDNA sequence for clone 27632.
SEQ ID NO: 432 is the determined cDNA sequence for clone 27633.
SEQ ID NO: 433 is the determined cDNA sequence for clone 27635.
SEQ ID NO: 434 is the determined cDNA sequence for clone 27636.
SEQ ID NO: 435 is the determined cDNA sequence for clone 27637.
SEQ ID NO: 436 is the determined cDNA sequence for clone 27638.
SEQ ID NO: 437 is the determined cDNA sequence for clone 27639.
SEQ ID NO: 438 is the determined cDNA sequence for clone 27640.
SEQ ID NO: 439 is the determined cDNA sequence for clone 27641.
SEQ ID NO: 440 is the determined cDNA sequence for clone 27642.
SEQ ID NO: 441 is the determined cDNA sequence for clone 27644.
SEQ ID NO: 442 is the determined cDNA sequence for clone 27646.
SEQ ID NO: 443 is the determined cDNA sequence for clone 27647.
SEQ ID NO: 444 is the determined cDNA sequence for clone 27649.
SEQ ID NO: 445 is the determined cDNA sequence for clone 27650.
SEQ ID NO: 446 is the determined cDNA sequence for clone 27651.
SEQ ID NO: 447 is the determined cDNA sequence for clone 27652.
SEQ ID NO: 448 is the determined cDNA sequence for clone 27654.
SEQ ID NO: 449 is the determined cDNA sequence for clone 27655.
SEQ ID NO: 450 is the determined cDNA sequence for clone 27657.
SEQ ID NO: 451 is the determined cDNA sequence for clone 27659.
SEQ ID NO: 452 is the determined cDNA sequence for clone 27665.
SEQ ID NO: 453 is the determined cDNA sequence for clone 27666.
SEQ ID NO: 454 is the determined cDNA sequence for clone 27668.
SEQ ID NO: 455 is the determined cDNA sequence for clone 27670.
SEQ ID NO: 456 is the determined cDNA sequence for clone 27671.
SEQ ID NO: 457 is the determined cDNA sequence for clone 27672.

SEQ ID NO: 458 is the determined cDNA sequence for clone 27674.
SEQ ID NO: 459 is the determined cDNA sequence for clone 27677.
SEQ ID NO: 460 is the determined cDNA sequence for clone 27681.
SEQ ID NO: 461 is the determined cDNA sequence for clone 27682.
SEQ ID NO: 462 is the determined cDNA sequence for clone 27683.
SEQ ID NO: 463 is the determined cDNA sequence for clone 27686.
SEQ ID NO: 464 is the determined cDNA sequence for clone 27688.
SEQ ID NO: 465 is the determined cDNA sequence for clone 27689.
SEQ ID NO: 466 is the determined cDNA sequence for clone 27690.
SEQ ID NO: 467 is the determined cDNA sequence for clone 27693.
SEQ ID NO: 468 is the determined cDNA sequence for clone 27699.
SEQ ID NO: 469 is the determined cDNA sequence for clone 27700.
SEQ ID NO: 470 is the determined cDNA sequence for clone 27702.
SEQ ID NO: 471 is the determined cDNA sequence for clone 27705.
SEQ ID NO: 472 is the determined cDNA sequence for clone 27706.
SEQ ID NO: 473 is the determined cDNA sequence for clone 27707.
SEQ ID NO: 474 is the determined cDNA sequence for clone 27708.
SEQ ID NO: 475 is the determined cDNA sequence for clone 27709.
SEQ ID NO: 476 is the determined cDNA sequence for clone 27710.
SEQ ID NO: 477 is the determined cDNA sequence for clone 27711.
SEQ ID NO: 478 is the determined cDNA sequence for clone 27712.
SEQ ID NO: 479 is the determined cDNA sequence for clone 27713.
SEQ ID NO: 480 is the determined cDNA sequence for clone 27714.
SEQ ID NO: 481 is the determined cDNA sequence for clone 27715.
SEQ ID NO: 482 is the determined cDNA sequence for clone 27716.
SEQ ID NO: 483 is the determined cDNA sequence for clone 27717.
SEQ ID NO: 484 is the determined cDNA sequence for clone 27718.
SEQ ID NO: 485 is the determined cDNA sequence for clone 27719.
SEQ ID NO: 486 is the determined cDNA sequence for clone 27720.
SEQ ID NO: 487 is the determined cDNA sequence for clone 27722.
SEQ ID NO: 488 is the determined cDNA sequence for clone 27723.
SEQ ID NO: 489 is the determined cDNA sequence for clone 27724.
SEQ ID NO: 490 is the determined cDNA sequence for clone 27726.
SEQ ID NO: 491 is the determined cDNA sequence for clone 25015.
SEQ ID NO: 492 is the determined cDNA sequence for clone 25016.
SEQ ID NO: 493 is the determined cDNA sequence for clone 25017.
SEQ ID NO: 494 is the determined cDNA sequence for clone 25018.
SEQ ID NO: 495 is the determined cDNA sequence for clone 25030.
SEQ ID NO: 496 is the determined cDNA sequence for clone 25033.
SEQ ID NO: 497 is the determined cDNA sequence for clone 25034.
SEQ ID NO: 498 is the determined cDNA sequence for clone 25035.
SEQ ID NO: 499 is the determined cDNA sequence for clone 25036.
SEQ ID NO: 500 is the determined cDNA sequence for clone 25037.
SEQ ID NO: 501 is the determined cDNA sequence for clone 25038.
SEQ ID NO: 502 is the determined cDNA sequence for clone 25039.
SEQ ID NO: 503 is the determined cDNA sequence for clone 25040.
SEQ ID NO: 504 is the determined cDNA sequence for clone 25042.
SEQ ID NO: 505 is the determined cDNA sequence for clone 25043.
SEQ ID NO: 506 is the determined cDNA sequence for clone 25044.
SEQ ID NO: 507 is the determined cDNA sequence for clone 25045.
SEQ ID NO: 508 is the determined cDNA sequence for clone 25047.
SEQ ID NO: 509 is the determined cDNA sequence for clone 25048.
SEQ ID NO: 510 is the determined cDNA sequence for clone 25049.
SEQ ID NO: 511 is the determined cDNA sequence for clone 25185.
SEQ ID NO: 512 is the determined cDNA sequence for clone 25186.
SEQ ID NO: 513 is the determined cDNA sequence for clone 25187.
SEQ ID NO: 514 is the determined cDNA sequence for clone 25188.
SEQ ID NO: 515 is the determined cDNA sequence for clone 25189.
SEQ ID NO: 516 is the determined cDNA sequence for clone 25190.
SEQ ID NO: 517 is the determined cDNA sequence for clone 25193.
SEQ ID NO: 518 is the determined cDNA sequence for clone 25194.
SEQ ID NO: 519 is the determined cDNA sequence for clone 25196.

SEQ ID NO: 520 is the determined cDNA sequence for clone 25198.
SEQ ID NO: 521 is the determined cDNA sequence for clone 25199.
SEQ ID NO: 522 is the determined cDNA sequence for clone 25200.
SEQ ID NO: 523 is the determined cDNA sequence for clone 25202.
SEQ ID NO: 524 is the determined cDNA sequence for clone 25364.
SEQ ID NO: 525 is the determined cDNA sequence for clone 25366.
SEQ ID NO: 526 is the determined cDNA sequence for clone 25367.
SEQ ID NO: 527 is the determined cDNA sequence for clone 25368.
SEQ ID NO: 528 is the determined cDNA sequence for clone 25369.
SEQ ID NO: 529 is the determined cDNA sequence for clone 25370.
SEQ ID NO: 530 is the determined cDNA sequence for clone 25371.
SEQ ID NO: 531 is the determined cDNA sequence for clone 25372.
SEQ ID NO: 532 is the determined cDNA sequence for clone 25373.
SEQ ID NO: 533 is the determined cDNA sequence for clone 25374.
SEQ ID NO: 534 is the determined cDNA sequence for clone 25376.
SEQ ID NO: 535 is the determined cDNA sequence for clone 25377.
SEQ ID NO: 536 is the determined cDNA sequence for clone 25378.
SEQ ID NO: 537 is the determined cDNA sequence for clone 25379.
SEQ ID NO: 538 is the determined cDNA sequence for clone 25380.
SEQ ID NO: 539 is the determined cDNA sequence for clone 25381.
SEQ ID NO: 540 is the determined cDNA sequence for clone 25382.
SEQ ID NO: 541 is the determined cDNA sequence for clone 25383.
SEQ ID NO: 542 is the determined cDNA sequence for clone 25385.
SEQ ID NO: 543 is the determined cDNA sequence for clone 25386.
SEQ ID NO: 544 is the determined cDNA sequence for clone 25387.
SEQ ID NO: 545 is the determined cDNA sequence for clone 26013.
SEQ ID NO: 546 is the determined cDNA sequence for clone 26014.
SEQ ID NO: 547 is the determined cDNA sequence for clone 26016.
SEQ ID NO: 548 is the determined cDNA sequence for clone 26017.
SEQ ID NO: 549 is the determined cDNA sequence for clone 26018.
SEQ ID NO: 550 is the determined cDNA sequence for clone 26019.
SEQ ID NO: 551 is the determined cDNA sequence for clone 26020.
SEQ ID NO: 552 is the determined cDNA sequence for clone 26021.
SEQ ID NO: 553 is the determined cDNA sequence for clone 26022.
SEQ ID NO: 554 is the determined cDNA sequence for clone 26027.
SEQ ID NO: 555 is the determined cDNA sequence for clone 26197.
SEQ ID NO: 556 is the determined cDNA sequence for clone 26199.
SEQ ID NO: 557 is the determined cDNA sequence for clone 26201.
SEQ ID NO: 558 is the determined cDNA sequence for clone 26202.
SEQ ID NO: 559 is the determined cDNA sequence for clone 26203.
SEQ ID NO: 560 is the determined cDNA sequence for clone 26204.
SEQ ID NO: 561 is the determined cDNA sequence for clone 26205.
SEQ ID NO: 562 is the determined cDNA sequence for clone 26206.
SEQ ID NO: 563 is the determined cDNA sequence for clone 26208.
SEQ ID NO: 564 is the determined cDNA sequence for clone 26211.
SEQ ID NO: 565 is the determined cDNA sequence for clone 26212.
SEQ ID NO: 566 is the determined cDNA sequence for clone 26213.
SEQ ID NO: 567 is the determined cDNA sequence for clone 26214.
SEQ ID NO: 568 is the determined cDNA sequence for clone 26215.
SEQ ID NO: 569 is the determined cDNA sequence for clone 26216.
SEQ ID NO: 570 is the determined cDNA sequence for clone 26217.
SEQ ID NO: 571 is the determined cDNA sequence for clone 26218.
SEQ ID NO: 572 is the determined cDNA sequence for clone 26219.
SEQ ID NO: 573 is the determined cDNA sequence for clone 26220.
SEQ ID NO: 574 is the determined cDNA sequence for clone 26221.
SEQ ID NO: 575 is the determined cDNA sequence for clone 26224.
SEQ ID NO: 576 is the determined cDNA sequence for clone 26225.
SEQ ID NO: 577 is the determined cDNA sequence for clone 26226.
SEQ ID NO: 578 is the determined cDNA sequence for clone 26227.
SEQ ID NO: 579 is the determined cDNA sequence for clone 26228.
SEQ ID NO: 580 is the determined cDNA sequence for clone 26230.
SEQ ID NO: 581 is the determined cDNA sequence for clone 26230.

SEQ ID NO: 582 is the determined cDNA sequence for clone 26231.
SEQ ID NO: 582 is the determined cDNA sequence for clone 26234.
SEQ ID NO: 583 is the determined cDNA sequence for clone 26236.
SEQ ID NO: 584 is the determined cDNA sequence for clone 26237.
SEQ ID NO: 585 is the determined cDNA sequence for clone 26239.
SEQ ID NO: 586 is the determined cDNA sequence for clone 26240.
SEQ ID NO: 587 is the determined cDNA sequence for clone 26241.
SEQ ID NO: 588 is the determined cDNA sequence for clone 26242.
SEQ ID NO: 589 is the determined cDNA sequence for clone 26246.
SEQ ID NO: 590 is the determined cDNA sequence for clone 26247.
SEQ ID NO: 591 is the determined cDNA sequence for clone 26248.
SEQ ID NO: 592 is the determined cDNA sequence for clone 26249.
SEQ ID NO: 593 is the determined cDNA sequence for clone 26250.
SEQ ID NO: 594 is the determined cDNA sequence for clone 26251.
SEQ ID NO: 595 is the determined cDNA sequence for clone 26252.
SEQ ID NO: 596 is the determined cDNA sequence for clone 26253.
SEQ ID NO: 597 is the determined cDNA sequence for clone 26254.
SEQ ID NO: 598 is the determined cDNA sequence for clone 26255.
SEQ ID NO: 599 is the determined cDNA sequence for clone 26256.
SEQ ID NO: 600 is the determined cDNA sequence for clone 26257.
SEQ ID NO: 601 is the determined cDNA sequence for clone 26259.
SEQ ID NO: 602 is the determined cDNA sequence for clone 26260.
SEQ ID NO: 603 is the determined cDNA sequence for clone 26261.
SEQ ID NO: 604 is the determined cDNA sequence for clone 26262.
SEQ ID NO: 605 is the determined cDNA sequence for clone 26263.
SEQ ID NO: 606 is the determined cDNA sequence for clone 26264.
SEQ ID NO: 607 is the determined cDNA sequence for clone 26265.
SEQ ID NO: 608 is the determined cDNA sequence for clone 26266.
SEQ ID NO: 609 is the determined cDNA sequence for clone 26268.
SEQ ID NO: 610 is the determined cDNA sequence for clone 26269.
SEQ ID NO: 611 is the determined cDNA sequence for clone 26271.
SEQ ID NO: 612 is the determined cDNA sequence for clone 26273.
SEQ ID NO: 613 is the determined cDNA sequence for clone 26810.
SEQ ID NO: 614 is the determined cDNA sequence for clone 26811.
SEQ ID NO: 615 is the determined cDNA sequence for clone 26812.1.
SEQ ID NO: 616 is the determined cDNA sequence for clone 26812.2.
SEQ ID NO: 617 is the determined cDNA sequence for clone 26813.
SEQ ID NO: 618 is the determined cDNA sequence for clone 26814.
SEQ ID NO: 619 is the determined cDNA sequence for clone 26815.
SEQ ID NO: 620 is the determined cDNA sequence for clone 26816.
SEQ ID NO: 621 is the determined cDNA sequence for clone 26818.
SEQ ID NO: 622 is the determined cDNA sequence for clone 26819.
SEQ ID NO: 623 is the determined cDNA sequence for clone 26820.
SEQ ID NO: 624 is the determined cDNA sequence for clone 26821.
SEQ ID NO: 625 is the determined cDNA sequence for clone 26822.
SEQ ID NO: 626 is the determined cDNA sequence for clone 26824.
SEQ ID NO: 627 is the determined cDNA sequence for clone 26825.
SEQ ID NO: 628 is the determined cDNA sequence for clone 26826.
SEQ ID NO: 629 is the determined cDNA sequence for clone 26827.
SEQ ID NO: 630 is the determined cDNA sequence for clone 26829.
SEQ ID NO: 631 is the determined cDNA sequence for clone 26830.
SEQ ID NO: 632 is the determined cDNA sequence for clone 26831.
SEQ ID NO: 633 is the determined cDNA sequence for clone 26832.
SEQ ID NO: 634 is the determined cDNA sequence for clone 26835.
SEQ ID NO: 635 is the determined cDNA sequence for clone 26836.
SEQ ID NO: 636 is the determined cDNA sequence for clone 26837.
SEQ ID NO: 637 is the determined cDNA sequence for clone 26839.
SEQ ID NO: 638 is the determined cDNA sequence for clone 26841.
SEQ ID NO: 639 is the determined cDNA sequence for clone 26843.
SEQ ID NO: 640 is the determined cDNA sequence for clone 26844.
SEQ ID NO: 641 is the determined cDNA sequence for clone 26845.
SEQ ID NO: 642 is the determined cDNA sequence for clone 26846.

SEQ ID NO: 643 is the determined cDNA sequence for clone 26847.
SEQ ID NO: 644 is the determined cDNA sequence for clone 26848.
SEQ ID NO: 645 is the determined cDNA sequence for clone 26849.
SEQ ID NO: 646 is the determined cDNA sequence for clone 26850.
SEQ ID NO: 647 is the determined cDNA sequence for clone 26851.
SEQ ID NO: 648 is the determined cDNA sequence for clone 26852.
SEQ ID NO: 649 is the determined cDNA sequence for clone 26853.
SEQ ID NO: 650 is the determined cDNA sequence for clone 26854.
SEQ ID NO: 651 is the determined cDNA sequence for clone 26856.
SEQ ID NO: 652 is the determined cDNA sequence for clone 26857.
SEQ ID NO: 653 is the determined cDNA sequence for clone 26858.
SEQ ID NO: 654 is the determined cDNA sequence for clone 26859.
SEQ ID NO: 655 is the determined cDNA sequence for clone 26860.
SEQ ID NO: 656 is the determined cDNA sequence for clone 26862.
SEQ ID NO: 657 is the determined cDNA sequence for clone 26863.
SEQ ID NO: 658 is the determined cDNA sequence for clone 26864.
SEQ ID NO: 659 is the determined cDNA sequence for clone 26865.
SEQ ID NO: 660 is the determined cDNA sequence for clone 26867.
SEQ ID NO: 661 is the determined cDNA sequence for clone 26868.
SEQ ID NO: 662 is the determined cDNA sequence for clone 26871.
SEQ ID NO: 663 is the determined cDNA sequence for clone 26873.
SEQ ID NO: 664 is the determined cDNA sequence for clone 26875.
SEQ ID NO: 665 is the determined cDNA sequence for clone 26876.
SEQ ID NO: 666 is the determined cDNA sequence for clone 26877.
SEQ ID NO: 667 is the determined cDNA sequence for clone 26878.
SEQ ID NO: 668 is the determined cDNA sequence for clone 26880.
SEQ ID NO: 669 is the determined cDNA sequence for clone 26882.
SEQ ID NO: 670 is the determined cDNA sequence for clone 26883.
SEQ ID NO: 671 is the determined cDNA sequence for clone 26884.
SEQ ID NO: 672 is the determined cDNA sequence for clone 26885.
SEQ ID NO: 673 is the determined cDNA sequence for clone 26886.
SEQ ID NO: 674 is the determined cDNA sequence for clone 26887.
SEQ ID NO: 675 is the determined cDNA sequence for clone 26888.
SEQ ID NO: 676 is the determined cDNA sequence for clone 26889.
SEQ ID NO: 677 is the determined cDNA sequence for clone 26890.
SEQ ID NO: 678 is the determined cDNA sequence for clone 26892.
SEQ ID NO: 679 is the determined cDNA sequence for clone 26894.
SEQ ID NO: 680 is the determined cDNA sequence for clone 26895.
SEQ ID NO: 681 is the determined cDNA sequence for clone 26897.
SEQ ID NO: 682 is the determined cDNA sequence for clone 26898.
SEQ ID NO: 683 is the determined cDNA sequence for clone 26899.
SEQ ID NO: 684 is the determined cDNA sequence for clone 26900.
SEQ ID NO: 685 is the determined cDNA sequence for clone 26901.
SEQ ID NO: 686 is the determined cDNA sequence for clone 26903.
SEQ ID NO: 687 is the determined cDNA sequence for clone 26905.
SEQ ID NO: 688 is the determined cDNA sequence for clone 26906.
SEQ ID NO: 689 is the determined cDNA sequence for clone 26708.
SEQ ID NO: 690 is the determined cDNA sequence for clone 26709.
SEQ ID NO: 691 is the determined cDNA sequence for clone 26710.
SEQ ID NO: 692 is the determined cDNA sequence for clone 26711.
SEQ ID NO: 693 is the determined cDNA sequence for clone 26712.
SEQ ID NO: 694 is the determined cDNA sequence for clone 26713.
SEQ ID NO: 695 is the determined cDNA sequence for clone 26714.
SEQ ID NO: 696 is the determined cDNA sequence for clone 26715.
SEQ ID NO: 697 is the determined cDNA sequence for clone 26716.
SEQ ID NO: 698 is the determined cDNA sequence for clone 26717.
SEQ ID NO: 699 is the determined cDNA sequence for clone 26718.
SEQ ID NO: 700 is the determined cDNA sequence for clone 26719.
SEQ ID NO: 701 is the determined cDNA sequence for clone 26720.
SEQ ID NO: 702 is the determined cDNA sequence for clone 26721.
SEQ ID NO: 703 is the determined cDNA sequence for clone 26722.
SEQ ID NO: 704 is the determined cDNA sequence for clone 26723.

SEQ ID NO: 705 is the determined cDNA sequence for clone 26724.
SEQ ID NO: 706 is the determined cDNA sequence for clone 26725.
SEQ ID NO: 707 is the determined cDNA sequence for clone 26726.
SEQ ID NO: 708 is the determined cDNA sequence for clone 26727.
SEQ ID NO: 709 is the determined cDNA sequence for clone 26728.
SEQ ID NO: 710 is the determined cDNA sequence for clone 26729.
SEQ ID NO: 711 is the determined cDNA sequence for clone 26730.
SEQ ID NO: 712 is the determined cDNA sequence for clone 26731.
SEQ ID NO: 713 is the determined cDNA sequence for clone 26732.
SEQ ID NO: 714 is the determined cDNA sequence for clone 26733.1.
SEQ ID NO: 715 is the determined cDNA sequence for clone 26733.2.
SEQ ID NO: 716 is the determined cDNA sequence for clone 26734.
SEQ ID NO: 717 is the determined cDNA sequence for clone 26735.
SEQ ID NO: 718 is the determined cDNA sequence for clone 26736.
SEQ ID NO: 719 is the determined cDNA sequence for clone 26737.
SEQ ID NO: 720 is the determined cDNA sequence for clone 26738.
SEQ ID NO: 721 is the determined cDNA sequence for clone 26739.
SEQ ID NO: 722 is the determined cDNA sequence for clone 26741.
SEQ ID NO: 723 is the determined cDNA sequence for clone 26742.
SEQ ID NO: 724 is the determined cDNA sequence for clone 26743.
SEQ ID NO: 725 is the determined cDNA sequence for clone 26744.
SEQ ID NO: 726 is the determined cDNA sequence for clone 26745.
SEQ ID NO: 727 is the determined cDNA sequence for clone 26746.
SEQ ID NO: 728 is the determined cDNA sequence for clone 26747.
SEQ ID NO: 729 is the determined cDNA sequence for clone 26748.
SEQ ID NO: 730 is the determined cDNA sequence for clone 26749.
SEQ ID NO: 731 is the determined cDNA sequence for clone 26750.
SEQ ID NO: 732 is the determined cDNA sequence for clone 26751.
SEQ ID NO: 733 is the determined cDNA sequence for clone 26752.
SEQ ID NO: 734 is the determined cDNA sequence for clone 26753.
SEQ ID NO: 735 is the determined cDNA sequence for clone 26754.
SEQ ID NO: 736 is the determined cDNA sequence for clone 26755.
SEQ ID NO: 737 is the determined cDNA sequence for clone 26756.
SEQ ID NO: 738 is the determined cDNA sequence for clone 26757.
SEQ ID NO: 739 is the determined cDNA sequence for clone 26758.
SEQ ID NO: 740 is the determined cDNA sequence for clone 26759.
SEQ ID NO: 741 is the determined cDNA sequence for clone 26760.
SEQ ID NO: 742 is the determined cDNA sequence for clone 26761.
SEQ ID NO: 743 is the determined cDNA sequence for clone 26762.
SEQ ID NO: 744 is the determined cDNA sequence for clone 26763.
SEQ ID NO: 745 is the determined cDNA sequence for clone 26764.
SEQ ID NO: 746 is the determined cDNA sequence for clone 26765.
SEQ ID NO: 747 is the determined cDNA sequence for clone 26766.
SEQ ID NO: 748 is the determined cDNA sequence for clone 26767.
SEQ ID NO: 749 is the determined cDNA sequence for clone 26768.
SEQ ID NO: 750 is the determined cDNA sequence for clone 26769.
SEQ ID NO: 751 is the determined cDNA sequence for clone 26770.
SEQ ID NO: 752 is the determined cDNA sequence for clone 26771.
SEQ ID NO: 753 is the determined cDNA sequence for clone 26772.
SEQ ID NO: 754 is the determined cDNA sequence for clone 26773.
SEQ ID NO: 755 is the determined cDNA sequence for clone 26774.
SEQ ID NO: 756 is the determined cDNA sequence for clone 26775.
SEQ ID NO: 757 is the determined cDNA sequence for clone 26776.
SEQ ID NO: 758 is the determined cDNA sequence for clone 26777.
SEQ ID NO: 759 is the determined cDNA sequence for clone 26778.
SEQ ID NO: 760 is the determined cDNA sequence for clone 26779.
SEQ ID NO: 761 is the determined cDNA sequence for clone 26781.
SEQ ID NO: 762 is the determined cDNA sequence for clone 26782.
SEQ ID NO: 763 is the determined cDNA sequence for clone 26783.
SEQ ID NO: 764 is the determined cDNA sequence for clone 26784.
SEQ ID NO: 765 is the determined cDNA sequence for clone 26785.
SEQ ID NO: 766 is the determined cDNA sequence for clone 26786.

SEQ ID NO: 767 is the determined cDNA sequence for clone 26787.

SEQ ID NO: 768 is the determined cDNA sequence for clone 26788.

SEQ ID NO: 769 is the determined cDNA sequence for clone 26790.

SEQ ID NO: 770 is the determined cDNA sequence for clone 26791.

SEQ ID NO: 771 is the determined cDNA sequence for clone 26792.

SEQ ID NO: 772 is the determined cDNA sequence for clone 26793.

SEQ ID NO: 773 is the determined cDNA sequence for clone 26794.

SEQ ID NO: 774 is the determined cDNA sequence for clone 26795.

SEQ ID NO: 775 is the determined cDNA sequence for clone 26796.

SEQ ID NO: 776 is the determined cDNA sequence for clone 26797.

SEQ ID NO: 777 is the determined cDNA sequence for clone 26798.

SEQ ID NO: 778 is the determined cDNA sequence for clone 26800.

SEQ ID NO: 779 is the determined cDNA sequence for clone 26801.

SEQ ID NO: 780 is the determined cDNA sequence for clone 26802.

SEQ ID NO: 781 is the determined cDNA sequence for clone 26803.

SEQ ID NO: 782 is the determined cDNA sequence for clone 26804.

SEQ ID NO: 783 is the amino acid sequence for L773P.

SEQ ID NO: 784 is the determined DNA sequence of the L773P expression construct.

SEQ ID NO: 785 is the determined DNA sequence of the L773PA expression construct.

SEQ ID NO: 786 is a predicted amino acid sequence for L552S.

SEQ ID NO: 787 is a predicted amino acid sequence for L840P.

SEQ ID NO: 788 is the full-length cDNA sequence for L548S.

SEQ ID NO: 789 is the amino acid sequence encoded by SEQ ID NO: 788.

DETAILED DESCRIPTION OF THE INVENTION

As noted above, the present invention is generally directed to compositions and methods for the therapy and diagnosis of cancer, such as lung cancer. The compositions described herein may include lung tumor polypeptides, polynucleotides encoding such polypeptides, binding agents such as antibodies, antigen presenting cells (APCs) and/or immune system cells (e.g., T cells). Polypeptides of the present invention generally comprise at least a portion (such as an immunogenic portion) of a lung tumor protein or a variant thereof. As used herein, a "lung tumor protein" is a protein that is expressed in lung tumor cells at a level that is at least two fold, and preferably at least five fold, greater than the level of expression in a normal tissue, as determined using a representative assay provided herein. Certain lung tumor proteins are tumor proteins that react detectably (within an immunoassay, such as an ELISA or Western blot) with antisera of a patient afflicted with lung cancer. Polynucleotides of the subject invention generally comprise a DNA or RNA sequence that encodes all or a portion of such a polypeptide, or that is complementary to such a sequence. Antibodies are generally immune system proteins, or antigen-binding fragments thereof, that are capable of binding to a polypeptide as described above. Antigen presenting cells include dendritic cells and macrophages that express a polypeptide as described above. T cells that may be employed within such compositions are generally T cells that are specific for a polypeptide as described above.

The present invention is based on the discovery of human lung tumor proteins. Partial and/or full-length sequences of polynucleotides encoding specific tumor proteins are provided in SEQ ID NO:1–782, 784, 785 and 788.

Lung Tumor Protein Polynucleotides

Any polynucleotide that encodes a lung tumor protein or a portion or other variant thereof as described herein is encompassed by the present invention. Preferred polynucleotides comprise at least 15 consecutive nucleotides, preferably at least 30 consecutive nucleotides and more preferably at least 45 consecutive nucleotides, of a sequence that encodes a portion of a lung tumor protein. More preferably, a polynucleotide encodes an immunogenic portion of a lung tumor protein. Polynucleotides complementary to any such sequences are also encompassed by the present invention. Polynucleotides may be single-stranded (coding or antisense) or double-stranded, and may be DNA (genomic, cDNA or synthetic) or RNA molecules. RNA molecules include HnRNA molecules, which contain introns and correspond to a DNA molecule in a one-to-one manner, and mRNA molecules, which do not contain introns. Additional coding or non-coding sequences may, but need not, be present within a polynucleotide of the present invention, and a polynucleotide may, but need not, be linked to other molecules and/or support materials.

Polynucleotides may comprise a native sequence (i.e., an endogenous sequence that encodes a lung tumor protein or a portion thereof) or may comprise a variant of such a sequence. Polynucleotide variants may contain one or more substitutions, additions, deletions and/or insertions such that the immunogenicity of the encoded polypeptide is not diminished, relative to a native tumor protein. The effect on the immunogenicity of the encoded polypeptide may generally be assessed as described herein. Variants preferably exhibit at least about 70% identity, more preferably at least about 80% identity and most preferably at least about 90% identity to a polynucleotide sequence that encodes a native lung tumor protein or a portion thereof.

Two polynucleotide or polypeptide sequences are said to be "identical" if the sequence of nucleotides or amino acids in the two sequences is the same when aligned for maximum correspondence as described below. Comparisons between two sequences are typically performed by comparing the sequences over a comparison window to identify and compare local regions of sequence similarity. A "comparison window" as used herein, refers to a segment of at least about 20 contiguous positions, usually 30 to about 75, 40 to about 50, in which a sequence may be compared to a reference sequence of the same number of contiguous positions after the two sequences are optimally aligned.

Optimal alignment of sequences for comparison may be conducted using the Megalign program in the Lasergene suite of bioinformatics software (DNASTAR, Inc., Madison, Wis.), using default parameters. This program embodies several alignment schemes described in the following references: Dayhoff, M. O. (1978) A model of evolutionary change in proteins—Matrices for detecting distant relationships. In Dayhoff, M. O. (ed.) Atlas of Protein Sequence and Structure, National Biomedical Research Foundation, Washington D.C. Vol. 5, Suppl. 3, pp. 345–358; Hein J. (1990) Unified Approach to Alignment and Phylogenes pp. 626–645 *Methods in Enzymology* vol. 183, Academic Press, Inc., San Diego, Calif.; Higgins, D. G. and Sharp, P. M. (1989) *CABIOS* 5:151–153; Myers, E. W. and Muller W. (1988) *CABIOS* 4:11–17; Robinson, E. D. (1971) *Comb. Theor* 11:105; Santou, N. Nes, M. (1987) *Mol. Biol. Evol.* 4:406–425; Sneath, P. H. A. and Sokal, R. R. (1973) *Numerical Taxonomy—the Principles and Practice of Numerical Taxonomy*, Freeman Press, San Francisco, Calif.; Wilbur, W. J. and Lipman, D. J. (1983) *Proc. Natl. Acad., Sci. USA* 80:726–730.

Preferably, the "percentage of sequence identity" is determined by comparing two optimally aligned sequences over a window of comparison of at least 20 positions, wherein the portion of the polynucleotide or polypeptide sequence in the comparison window may comprise additions or deletions (i.e. gaps) of 20 percent or less, usually 5 to 15 percent, or 10 to 12 percent, as compared to the reference sequences (which does not comprise additions or deletions) for optimal alignment of the two sequences. The percentage is calculated by determining the number of positions at which the identical nucleic acid bases or amino acid residue occurs in both sequences to yield the number of matched positions, dividing the number of matched positions by the total number of positions in the reference sequence (i.e. the window size) and multiplying the results by 100 to yield the percentage of sequence identity.

Variants may also, or alternatively, be substantially homologous to a native gene, or a portion or complement thereof. Such polynucleotide variants are capable of hybridizing under moderately stringent conditions to a naturally occurring DNA sequence encoding a native lung tumor protein (or a complementary sequence). Suitable moderately stringent conditions include prewashing in a solution of 5×SSC, 0.5% SDS, 1.0 mM EDTA (pH 8.0); hybridizing at 50° C.–65° C., 5×SSC, overnight; followed by washing twice at 65° C. for 20 minutes with each of 2×, 0.5× and 0.2×SSC containing 0.1% SDS.

It will be appreciated by those of ordinary skill in the art that, as a result of the degeneracy of the genetic code, there are many nucleotide sequences that encode a polypeptide as described herein. Some of these polynucleotides bear minimal homology to the nucleotide sequence of any native gene. Nonetheless, polynucleotides that vary due to differences in codon usage are specifically contemplated by the present invention. Further, alleles of the genes comprising the polynucleotide sequences provided herein are within the scope of the present invention. Alleles are endogenous genes that are altered as a result of one or more mutations, such as deletions, additions and/or substitutions of nucleotides. The resulting mRNA and protein may, but need not, have an altered structure or function. Alleles may be identified using standard techniques (such as hybridization, amplification and/or database sequence comparison).

Polynucleotides may be prepared using any of a variety of techniques. For example, a polynucleotide may be identified, as described in more detail below, by screening a microarray of cDNAs for tumor-associated expression (i.e., expression that is at least five fold greater in a lung tumor than in normal tissue, as determined using a representative assay provided herein). Such screens may be performed using an Incyte microarray (Palo Alto, Calif.) according to the manufacturer's instructions (and essentially as described by Schena et al., *Proc. Natl. Acad. Sci. USA* 93:10614–10619, 1996 and Heller et al., *Proc. Natl. Acad. Sci. USA* 94:2150–2155, 1997). Alternatively, polypeptides may be amplified from cDNA prepared from cells expressing the proteins described herein, such as lung tumor cells. Such polynucleotides may be amplified via polymerase chain reaction (PCR). For this approach, sequence-specific primers may be designed based on the sequences provided herein, and may be purchased or synthesized.

An amplified portion may be used to isolate a full length gene from a suitable library (e.g., a lung tumor cDNA library) using well known techniques. Within such techniques, a library (cDNA or genomic) is screened using one or more polynucleotide probes or primers suitable for amplification. Preferably, a library is size-selected to include larger molecules. Random primed libraries may also be preferred for identifying 5' and upstream regions of genes. Genomic libraries are preferred for obtaining introns and extending 5' sequences.

For hybridization techniques, a partial sequence may be labeled (e.g., by nick-translation or end-labeling with $^{32}P$) using well known techniques. A bacterial or bacteriophage library is then screened by hybridizing filters containing denatured bacterial colonies (or lawns containing phage plaques) with the labeled probe (see Sambrook et al., *Molecular Cloning: A Laboratory Manual*, Cold Spring Harbor Laboratories, Cold Spring Harbor, N.Y., 1989). Hybridizing colonies or plaques are selected and expanded, and the DNA is isolated for further analysis. cDNA clones may be analyzed to determine the amount of additional sequence by, for example, PCR using a primer from the partial sequence and a primer from the vector. Restriction maps and partial sequences may be generated to identify one or more overlapping clones. The complete sequence may then be determined using standard techniques, which may involve generating a series of deletion clones. The resulting overlapping sequences are then assembled into a single contiguous sequence. A full length cDNA molecule can be generated by ligating suitable fragments, using well known techniques.

Alternatively, there are numerous amplification techniques for obtaining a full length coding sequence from a partial cDNA sequence. Within such techniques, amplification is generally performed via PCR. Any of a variety of commercially available kits may be used to perform the amplification step. Primers may be designed using, for example, software well known in the art. Primers are preferably 22–30 nucleotides in length, have a GC content of at least 50% and anneal to the target sequence at temperatures of about 68° C. to 72° C. The amplified region may be sequenced as described above, and overlapping sequences assembled into a contiguous sequence.

One such amplification technique is inverse PCR (see Triglia et al., *Nucl. Acids Res.* 16:8186, 1988), which uses restriction enzymes to generate a fragment in the known region of the gene. The fragment is then circularized by intramolecular ligation and used as a template for PCR with divergent primers derived from the known region. Within an alternative approach, sequences adjacent to a partial sequence may be retrieved by amplification with a primer to a linker sequence and a primer specific to a known region. The amplified sequences are typically subjected to a second round of amplification with the same linker primer and a second primer specific to the known region. A variation on this procedure, which employs two primers that initiate extension in opposite directions from the known sequence, is described in WO 96/38591. Another such technique is known as "rapid amplification of cDNA ends" or RACE. This technique involves the use of an internal primer and an external primer, which hybridizes to a polyA region or vector sequence, to identify sequences that are 5' and 3' of a known sequence. Additional techniques include capture PCR (Lagerstrom et al., *PCR Methods Applic.* 1:111–19, 1991) and walking PCR (Parker et al., *Nucl. Acids. Res.* 19:3055–60, 1991). Other methods employing amplification may also be employed to obtain a full length cDNA sequence.

In certain instances, it is possible to obtain a full length cDNA sequence by analysis of sequences provided in an expressed sequence tag (EST) database, such as that available from GenBank. Searches for overlapping ESTs may generally be performed using well known programs (e.g., NCBI BLAST searches), and such ESTs may be used to generate a contiguous full length sequence.

Certain nucleic acid sequences of cDNA molecules encoding portions of lung tumor proteins are provided in SEQ ID NO: 1–782, 784, 785 and 788. These polynucleotides were isolated from lung tumor cDNA libraries using conventional and/or PCR-based subtraction techniques, as described below.

Polynucleotide variants may generally be prepared by any method known in the art, including chemical synthesis by, for example, solid phase phosphoramidite chemical synthesis. Modifications in a polynucleotide sequence may also be introduced using standard mutagenesis techniques, such as oligonucleotide-directed site-specific mutagenesis (see Adelman et al., *DNA* 2:183, 1983). Alternatively, RNA molecules may be generated by in vitro or in vivo transcription of DNA sequences encoding a lung tumor protein, or portion thereof, provided that the DNA is incorporated into a vector with a suitable RNA polymerase promoter (such as T7 or SP6). Certain portions may be used to prepare an encoded polypeptide, as described herein. In addition, or alternatively, a portion may be administered to a patient such that the encoded polypeptide is generated in vivo (e.g., by transfecting antigen-presenting cells, such as dendritic cells, with a cDNA construct encoding a lung tumor polypeptide, and administering the transfected cells to the patient).

A portion of a sequence complementary to a coding sequence (i.e., an antisense polynucleotide) may also be used as a probe or to modulate gene expression. cDNA constructs that can be transcribed into antisense RNA may also be introduced into cells of tissues to facilitate the production of antisense RNA. An antisense polynucleotide may be used, as described herein, to inhibit expression of a tumor protein. Antisense technology can be used to control gene expression through triple-helix formation, which compromises the ability of the double helix to open sufficiently for the binding of polymerases, transcription factors or regulatory molecules (see Gee et al., In Huber and Carr, *Molecular and Immunologic Approaches*, Futura Publishing Co. (Mt. Kisco, N.Y.; 1994)). Alternatively, an antisense molecule may be designed to hybridize with a control region of a gene (e.g., promoter, enhancer or transcription initiation site), and block transcription of the gene; or to block translation by inhibiting binding of a transcript to ribosomes.

A portion of a coding sequence, or of a complementary sequence, may also be designed as a probe or primer to detect gene expression. Probes may be labeled with a variety of reporter groups, such as radionuclides and enzymes, and are preferably at least 10 nucleotides in length, more preferably at least 20 nucleotides in length and still more preferably at least 30 nucleotides in length. Primers, as noted above, are preferably 22–30 nucleotides in length.

Any polynucleotide may be further modified to increase stability in vivo. Possible modifications include, but are not limited to, the addition of flanking sequences at the 5' and/or 3' ends; the use of phosphorothioate or 2' O-methyl rather than phosphodiesterase linkages in the backbone; and/or the inclusion of nontraditional bases such as inosine, queosine and wybutosine, as well as acetyl- methyl-, thio- and other modified forms of adenine, cytidine, guanine, thymine and uridine.

Nucleotide sequences as described herein may be joined to a variety of other nucleotide sequences using established recombinant DNA techniques. For example, a polynucleotide may be cloned into any of a variety of cloning vectors, including plasmids, phagemids, lambda phage derivatives and cosmids. Vectors of particular interest include expression vectors, replication vectors, probe generation vectors and sequencing vectors. In general, a vector will contain an origin of replication functional in at least one organism, convenient restriction endonuclease sites and one or more selectable markers. Other elements will depend upon the desired use, and will be apparent to those of ordinary skill in the art.

Within certain embodiments, polynucleotides may be formulated so as to permit entry into a cell of a mammal, and expression therein. Such formulations are particularly useful for therapeutic purposes, as described below. Those of ordinary skill in the art will appreciate that there are many ways to achieve expression of a polynucleotide in a target cell, and any suitable method may be employed. For example, a polynucleotide may be incorporated into a viral vector such as, but not limited to, adenovirus, adeno-associated virus, retrovirus, or vaccinia or other pox virus (e.g., avian pox virus). Techniques for incorporating DNA into such vectors are well known to those of ordinary skill in the art. A retroviral vector may additionally transfer or incorporate a gene for a selectable marker (to aid in the identification or selection of transduced cells) and/or a targeting moiety, such as a gene that encodes a ligand for a receptor on a specific target cell, to render the vector target specific. Targeting may also be accomplished using an antibody, by methods known to those of ordinary skill in the art.

Other formulations for therapeutic purposes include colloidal dispersion systems, such as macromolecule complexes, nanocapsules, microspheres, beads, and lipid-based systems including oil-in-water emulsions, micelles, mixed micelles, and liposomes. A preferred colloidal system for use as a delivery vehicle in vitro and in vivo is a liposome (i.e., an artificial membrane vesicle). The preparation and use of such systems is well known in the art.

Lung Tumor Polypeptides

Within the context of the present invention, polypeptides may comprise at least an immunogenic portion of a lung tumor protein or a variant thereof, as described herein. As noted above, a "lung tumor protein" is a protein that is expressed by lung tumor cells. Lung tumor proteins also react detectably within an immunoassay (such as an ELISA) with antisera from a patient with lung cancer. Polypeptides as described herein may be of any length. Additional sequences derived from the native protein and/or heterologous sequences may be present, and such sequences may (but need not) possess further immunogenic or antigenic properties.

An "immunogenic portion," as used herein is a portion of a protein that is recognized (i.e., specifically bound) by a B-cell and/or T-cell surface antigen receptor. Such immunogenic portions generally comprise at least 5 amino acid residues, more preferably at least 10, and still more preferably at least 20 amino acid residues, of a lung tumor protein or a variant thereof. Certain preferred immunogenic portions include peptides in which an N-terminal leader sequence and/or transmembrane domain have been deleted. Other preferred immunogenic portions may contain a small N- and/or C-terminal deletion (e.g., 1–30 amino acids, preferably 5–15 amino acids), relative to the mature protein.

Immunogenic portions may generally be identified using well known techniques, such as those summarized in Paul, *Fundamental Immunology*, 3rd ed., 243–247 (Raven Press, 1993) and references cited therein. Such techniques include screening polypeptides for the ability to react with antigen-specific antibodies, antisera and/or T-cell lines or clones. As used herein, antisera and antibodies are "antigen-specific" if they specifically bind to an antigen (i.e., they react with the protein in an ELISA or other immunoassay, and do not react detectably with unrelated proteins). Such antisera and antibodies may be prepared as described herein, and using well known techniques. An immunogenic portion of a native lung tumor protein is a portion that reacts with such antisera and/or T-cells at a level that is not substantially less than the reactivity of the full length polypeptide (e.g., in an ELISA and/or T-cell reactivity assay). Such immunogenic portions may react within such assays at a level that is similar to or greater than the reactivity of the full length polypeptide. Such screens may generally be performed using methods well known to those of ordinary skill in the art, such as those described in Harlow and Lane, *Antibodies: A Laboratory Manual*, Cold Spring Harbor Laboratory, 1988. For example, a polypeptide may be immobilized on a solid support and contacted with patient sera to allow binding of antibodies within the sera to the immobilized polypeptide. Unbound sera may then be removed and bound antibodies detected using, for example, $^{125}$I-labeled Protein A.

As noted above, a composition may comprise a variant of a native lung tumor protein. A polypeptide "variant," as used herein, is a polypeptide that differs from a native lung tumor protein in one or more substitutions, deletions, additions and/or insertions, such that the immunogenicity of the polypeptide is not substantially diminished. In other words, the ability of a variant to react with antigen-specific antisera may be enhanced or unchanged, relative to the native protein, or may be diminished by less than 50%, and preferably less than 20%, relative to the native protein. Such variants may generally be identified by modifying one of the above polypeptide sequences and evaluating the reactivity of the modified polypeptide with antigen-specific antibodies or antisera as described herein. Preferred variants include those in which one or more portions, such as an N-terminal leader sequence or transmembrane domain, have been removed. Other preferred variants include variants in which a small portion (e.g., 1–30 amino acids, preferably 5–15 amino acids) has been removed from the N- and/or C-terminal of the mature protein.

Polypeptide variants preferably exhibit at least about 70%, more preferably at least about 90% and most preferably at least about 95% identity (determined as described above) to the identified polypeptides.

Preferably, a variant contains conservative substitutions. A "conservative substitution" is one in which an amino acid is substituted for another amino acid that has similar properties, such that one skilled in the art of peptide chemistry would expect the secondary structure and hydropathic nature of the polypeptide to be substantially unchanged. Amino acid substitutions may generally be made on the basis of similarity in polarity, charge, solubility, hydrophobicity, hydrophilicity and/or the amphipathic nature of the residues. For example, negatively charged amino acids include aspartic acid and glutamic acid; positively charged amino acids include lysine and arginine; and amino acids with uncharged polar head groups having similar hydrophilicity values include leucine, isoleucine and valine; glycine and alanine; asparagine and glutamine; and serine, threonine, phenylalanine and tyrosine. Other groups of amino acids that may represent conservative changes include: (1) ala, pro, gly, glu, asp, gln, asn, ser, thr; (2) cys, ser, tyr, thr; (3) val, ile, leu, met, ala, phe; (4) lys, arg, his; and (5) phe, tyr, trp, his. A variant may also, or alternatively, contain nonconservative changes. In a preferred embodiment, variant polypeptides differ from a native sequence by substitution, deletion or addition of five amino acids or fewer. Variants may also (or alternatively) be modified by, for example, the deletion or addition of amino acids that have minimal influence on the immunogenicity, secondary structure and hydropathic nature of the polypeptide.

As noted above, polypeptides may comprise a signal (or leader) sequence at the N-terminal end of the protein which co-translationally or post-translationally directs transfer of the protein. The polypeptide may also be conjugated to a linker or other sequence for ease of synthesis, purification or identification of the polypeptide (e.g., poly-His), or to enhance binding of the polypeptide to a solid support. For example, a polypeptide may be conjugated to an immunoglobulin Fc region.

Polypeptides may be prepared using any of a variety of well known techniques. Recombinant polypeptides encoded by DNA sequences as described above may be readily prepared from the DNA sequences using any of a variety of expression vectors known to those of ordinary skill in the art. Expression may be achieved in any appropriate host cell that has been transformed or transfected with an expression vector containing a DNA molecule that encodes a recombinant polypeptide. Suitable host cells include prokaryotes, yeast and higher eukaryotic cells. Preferably, the host cells employed are *E. coli*, yeast or a mammalian cell line such as COS or CHO. Supernatants from suitable host/vector systems which secrete recombinant protein or polypeptide into culture media may be first concentrated using a commercially available filter. Following concentration, the concentrate may be applied to a suitable purification matrix such as an affinity matrix or an ion exchange resin. Finally, one or more reverse phase HPLC steps can be employed to further purify a recombinant polypeptide.

Portions and other variants having fewer than about 100 amino acids, and generally fewer than about 50 amino acids, may also be generated by synthetic means, using techniques well known to those of ordinary skill in the art. For example, such polypeptides may be synthesized using any of the commercially available solid-phase techniques, such as the Merrifield solid-phase synthesis method, where amino acids are sequentially added to a growing amino acid chain. See Merrifield, *J. Am. Chem. Soc.* 85:2149–2146, 1963. Equipment for automated synthesis of polypeptides is commercially available from suppliers such as Perkin Elmer/Applied BioSystems Division (Foster City, Calif.), and may be operated according to the manufacturer's instructions.

Within certain specific embodiments, a polypeptide may be a fusion protein that comprises multiple polypeptides as described herein, or that comprises at least one polypeptide as described herein and an unrelated sequence, such as a known tumor protein. A fusion partner may, for example, assist in providing T helper epitopes (an immunological fusion partner), preferably T helper epitopes recognized by humans, or may assist in expressing the protein (an expression enhancer) at higher yields than the native recombinant protein. Certain preferred fusion partners are both immunological and expression enhancing fusion partners. Other fusion partners may be selected so as to increase the solubility of the protein or to enable the protein to be targeted to desired intracellular compartments. Still further fusion partners include affinity tags, which facilitate purification of the protein.

Fusion proteins may generally be prepared using standard techniques, including chemical conjugation. Preferably, a fusion protein is expressed as a recombinant protein, allowing the production of increased levels, relative to a non-fused protein, in an expression system. Briefly, DNA sequences encoding the polypeptide components may be assembled separately, and ligated into an appropriate expression vector. The 3' end of the DNA sequence encoding one polypeptide component is ligated, with or without a peptide linker, to the 5' end of a DNA sequence encoding the second polypeptide component so that the reading frames of the sequences are in phase. This permits translation into a single fusion protein that retains the biological activity of both component polypeptides.

A peptide linker sequence may be employed to separate the first and the second polypeptide components by a distance sufficient to ensure that each polypeptide folds into its secondary and tertiary structures. Such a peptide linker sequence is incorporated into the fusion protein using standard techniques well known in the art. Suitable peptide linker sequences may be chosen based on the following factors: (1) their ability to adopt a flexible extended conformation; (2) their inability to adopt a secondary structure that could interact with functional epitopes on the first and second polypeptides; and (3) the lack of hydrophobic or charged residues that might react with the polypeptide functional epitopes. Preferred peptide linker sequences contain Gly, Asn and Ser residues. Other near neutral amino acids, such as Thr and Ala may also be used in the linker sequence. Amino acid sequences which may be usefully employed as linkers include those disclosed in Maratea et al., *Gene* 40:39–46, 1985; Murphy et al., *Proc. Natl. Acad. Sci. USA* 83:8258–8262, 1986; U.S. Pat. No. 4,935,233 and U.S. Pat. No. 4,751,180. The linker sequence may generally be from 1 to about 50 amino acids in length. Linker sequences are not required when the first and second polypeptides have non-essential N-terminal amino acid regions that can be used to separate the functional domains and prevent steric interference.

The ligated DNA sequences are operably linked to suitable transcriptional or translational regulatory elements. The regulatory elements responsible for expression of DNA are located only 5' to the DNA sequence encoding the first polypeptides. Similarly, stop codons required to end translation and transcription termination signals are only present 3' to the DNA sequence encoding the second polypeptide.

Fusion proteins are also provided that comprise a polypeptide of the present invention together with an unrelated immunogenic protein. Preferably the immunogenic protein is capable of eliciting a recall response. Examples of such proteins include tetanus, *tuberculosis* and hepatitis proteins (see, for example, Stoute et al. *New Engl. J. Med.*, 336:86–91, 1997).

Within preferred embodiments, an immunological fusion partner is derived from protein D, a surface protein of the gram-negative bacterium *Haemophilus influenza* B (WO 91/18926). Preferably, a protein D derivative comprises approximately the first third of the protein (e.g., the first N-terminal 100–110 amino acids), and a protein D derivative may be lipidated. Within certain preferred embodiments, the first 109 residues of a Lipoprotein D fusion partner is included on the N-terminus to provide the polypeptide with additional exogenous T-cell epitopes and to increase the expression level in *E. coli* (thus functioning as an expression enhancer). The lipid tail ensures optimal presentation of the antigen to antigen present cells. Other fusion partners include the non-structural protein from *influenzae* virus, NS1 (hemaglutinin). Typically, the N-terminal 81 amino acids are used, although different fragments that include T-helper epitopes may be used.

In another embodiment, the immunological fusion partner is the protein known as LYTA, or a portion thereof (preferably a C-terminal portion). LYTA is derived from *Streptococcus pneumoniae*, which synthesizes an N-acetyl-L-alanine amidase known as amidase LYTA (encoded by the LytA gene; *Gene* 43:265–292, 1986). LYTA is an autolysin that specifically degrades certain bonds in the peptidoglycan backbone. The C-terminal domain of the LYTA protein is responsible for the affinity to the choline or to some choline analogues such as DEAE. This property has been exploited for the development of *E. coli* C-LYTA expressing plasmids useful for expression of fusion proteins. Purification of hybrid proteins containing the C-LYTA fragment at the amino terminus has been described (see *Biotechnology* 10:795–798, 1992). Within a preferred embodiment, a repeat portion of LYTA may be incorporated into a fusion protein. A repeat portion is found in the C-terminal region starting at residue 178. A particularly preferred repeat portion incorporates residues 188–305.

In general, polypeptides (including fusion proteins) and polynucleotides as described herein are isolated. An "isolated" polypeptide or polynucleotide is one that is removed from its original environment. For example, a naturally-occurring protein is isolated if it is separated from some or all of the coexisting materials in the natural system. Preferably, such polypeptides are at least about 90% pure, more preferably at least about 95% pure and most preferably at least about 99% pure. A polynucleotide is considered to be isolated if, for example, it is cloned into a vector that is not a part of the natural environment.

Binding Agents

The present invention further provides agents, such as antibodies and antigen-binding fragments thereof, that specifically bind to a lung tumor protein. As used herein, an antibody, or antigen-binding fragment thereof, is said to "specifically bind" to a lung tumor protein if it reacts at a detectable level (within, for example, an ELISA) with a lung tumor protein, and does not react detectably with unrelated proteins under similar conditions. As used herein, "binding" refers to a noncovalent association between two separate molecules such that a complex is formed. The ability to bind may be evaluated by, for example, determining a binding constant for the formation of the complex. The binding constant is the value obtained when the concentration of the complex is divided by the product of the component concentrations. In general, two compounds are said to "bind," in the context of the present invention, when the binding constant for complex formation exceeds about $10^3$ L/mol. The binding constant may be determined using methods well known in the art.

Binding agents may be further capable of differentiating between patients with and without a cancer, such as lung cancer, using the representative assays provided herein. In other words, antibodies or other binding agents that bind to a lung tumor protein will generate a signal indicating the presence of a cancer in at least about 20% of patients with the disease, and will generate a negative signal indicating the absence of the disease in at least about 90% of individuals without the cancer. To determine whether a binding agent satisfies this requirement, biological samples (e.g., blood, sera, urine, sputum and/or tumor biopsies) from patients with and without a cancer (as determined using standard clinical tests) may be assayed as described herein for the presence of polypeptides that bind to the binding agent. It will be apparent that a statistically significant number of samples with and without the disease should be assayed. Each binding agent should satisfy the above criteria; however, those of ordinary skill in the art will recognize that binding agents may be used in combination to improve sensitivity.

Any agent that satisfies the above requirements may be a binding agent. For example, a binding agent may be a ribosome, with or without a peptide component, an RNA molecule or a polypeptide. In a preferred embodiment, a binding agent is an antibody or an antigen-binding fragment thereof. Antibodies may be prepared by any of a variety of techniques known to those of ordinary skill in the art. See, e.g., Harlow and Lane, *Antibodies: A Laboratory Manual*, Cold Spring Harbor Laboratory, 1988. In general, antibodies can be produced by cell culture techniques, including the generation of monoclonal antibodies as described herein, or via transfection of antibody genes into suitable bacterial or mammalian cell hosts, in order to allow for the production of recombinant antibodies. In one technique, an immunogen comprising the polypeptide is initially injected into any of a wide variety of mammals (e.g., mice, rats, rabbits, sheep or goats). In this step, the polypeptides of this invention may serve as the immunogen without modification. Alternatively, particularly for relatively short polypeptides, a superior immune response may be elicited if the polypeptide is joined to a carrier protein, such as bovine serum albumin or keyhole limpet hemocyanin. The immunogen is injected into the animal host, preferably according to a predetermined schedule incorporating one or more booster immunizations, and the animals are bled periodically. Polyclonal antibodies specific for the polypeptide may then be purified from such antisera by, for example, affinity chromatography using the polypeptide coupled to a suitable solid support.

Monoclonal antibodies specific for an antigenic polypeptide of interest may be prepared, for example, using the technique of Kohler and Milstein, *Eur. J. Immunol.* 6:511–519, 1976, and improvements thereto. Briefly, these methods involve the preparation of immortal cell lines capable of producing antibodies having the desired specificity (i.e., reactivity with the polypeptide of interest). Such cell lines may be produced, for example, from spleen cells obtained from an animal immunized as described above. The spleen cells are then immortalized by, for example, fusion with a myeloma cell fusion partner, preferably one that is syngeneic with the immunized animal. A variety of fusion techniques may be employed. For example, the spleen cells and myeloma cells may be combined with a nonionic detergent for a few minutes and then plated at low density on a selective medium that supports the growth of hybrid cells, but not myeloma cells. A preferred selection technique uses HAT (hypoxanthine, aminopterin, thymidine) selection. After a sufficient time, usually about 1 to 2 weeks, colonies of hybrids are observed. Single colonies are selected and their culture supernatants tested for binding activity against the polypeptide. Hybridomas having high reactivity and specificity are preferred.

Monoclonal antibodies may be isolated from the supernatants of growing hybridoma colonies. In addition, various techniques may be employed to enhance the yield, such as injection of the hybridoma cell line into the peritoneal cavity of a suitable vertebrate host, such as a mouse. Monoclonal antibodies may then be harvested from the ascites fluid or the blood. Contaminants may be removed from the antibodies by conventional techniques, such as chromatography, gel filtration, precipitation, and extraction. The polypeptides of this invention may be used in the purification process in, for example, an affinity chromatography step.

Within certain embodiments, the use of antigen-binding fragments of antibodies may be preferred. Such fragments include Fab fragments, which may be prepared using standard techniques. Briefly, immunoglobulins may be purified from rabbit serum by affinity chromatography on Protein A bead columns (Harlow and Lane, *Antibodies: A Laboratory Manual*, Cold Spring Harbor Laboratory, 1988) and digested by papain to yield Fab and Fc fragments. The Fab and Fc fragments may be separated by affinity chromatography on protein A bead columns.

Monoclonal antibodies of the present invention may be coupled to one or more therapeutic agents. Suitable agents in this regard include radionuclides, differentiation inducers, drugs, toxins, and derivatives thereof. Preferred radionuclides include $^{90}$Y, $^{123}$I, $^{125}$I, $^{131}$I, $^{186}$Re, $^{188}$Re, $^{211}$At, and $^{212}$Bi. Preferred drugs include methotrexate, and pyrimidine and purine analogs. Preferred differentiation inducers include phorbol esters and butyric acid. Preferred toxins include ricin, abrin, diptheria toxin, *cholera* toxin, gelonin, *Pseudomonas* exotoxin, *Shigella* toxin, and pokeweed antiviral protein.

A therapeutic agent may be coupled (e.g., covalently bonded) to a suitable monoclonal antibody either directly or indirectly (e.g., via a linker group). A direct reaction between an agent and an antibody is possible when each possesses a substituent capable of reacting with the other. For example, a nucleophilic group, such as an amino or sulfhydryl group, on one may be capable of reacting with a carbonyl-containing group, such as an anhydride or an acid halide, or with an alkyl group containing a good leaving group (e.g., a halide) on the other.

Alternatively, it may be desirable to couple a therapeutic agent and an antibody via a linker group. A linker group can function as a spacer to distance an antibody from an agent in order to avoid interference with binding capabilities. A linker group can also serve to increase the chemical reactivity of a substituent on an agent or an antibody, and thus increase the coupling efficiency. An increase in chemical reactivity may also facilitate the use of agents, or functional groups on agents, which otherwise would not be possible.

It will be evident to those skilled in the art that a variety of bifunctional or polyfunctional reagents, both homo- and hetero-functional (such as those described in the catalog of the Pierce Chemical Co., Rockford, Ill.), may be employed as the linker group. Coupling may be effected, for example, through amino groups, carboxyl groups, sulfhydryl groups or oxidized carbohydrate residues. There are numerous references describing such methodology, e.g. U.S. Pat. No. 4,671,958, to Rodwell et al.

Where a therapeutic agent is more potent when free from the antibody portion of the immunoconjugates of the present invention, it may be desirable to use a linker group which is cleavable during or upon internalization into a cell. A number of different cleavable linker groups have been described. The mechanisms for the intracellular release of an agent from these linker groups include cleavage by reduction of a disulfide bond (e.g., U.S. Pat. No. 4,489,710, to Spitler), by irradiation of a photolabile bond (e.g., U.S. Pat. No. 4,625,014, to Senter et al.), by hydrolysis of derivatized amino acid side chains (e.g., U.S. Pat. No. 4,638,045, to Kohn et al.), by serum complement-mediated hydrolysis (e.g., U.S. Pat. No. 4,671,958, to Rodwell et al.), and acid-catalyzed hydrolysis (e.g., U.S. Pat. No. 4,569,789, to Blattler et al.).

It may be desirable to couple more than one agent to an antibody. In one embodiment, multiple molecules of an agent are coupled to one antibody molecule. In another embodiment, more than one type of agent may be coupled to one antibody. Regardless of the particular embodiment, immunoconjugates with more than one agent may be prepared in a variety of ways. For example, more than one agent may be coupled directly to an antibody molecule, or linkers which provide multiple sites for attachment can be used. Alternatively, a carrier can be used.

A carrier may bear the agents in a variety of ways, including covalent bonding either directly or via a linker group. Suitable carriers include proteins such as albumins (e.g., U.S. Pat. No. 4,507,234, to Kato et al.), peptides and polysaccharides such as aminodextran (e.g., U.S. Pat. No. 4,699,784, to Shih et al.). A carrier may also bear an agent by noncovalent bonding or by encapsulation, such as within a liposome vesicle (e.g., U.S. Pat. Nos. 4,429,008 and 4,873,088). Carriers specific for radionuclide agents include radiohalogenated small molecules and chelating compounds. For example, U.S. Pat. No. 4,735,792 discloses representative radiohalogenated small molecules and their synthesis. A radionuclide chelate may be formed from chelating compounds that include those containing nitrogen and sulfur atoms as the donor atoms for binding the metal, or metal oxide, radionuclide. For example, U.S. Pat. No. 4,673,562, to Davison et al. discloses representative chelating compounds and their synthesis.

A variety of routes of administration for the antibodies and immunoconjugates may be used. Typically, administration will be intravenous, intramuscular, subcutaneous or in the bed of a resected tumor. It will be evident that the precise dose of the antibody/immunoconjugate will vary depending upon the antibody used, the antigen density on the tumor, and the rate of clearance of the antibody.

T Cells

Immunotherapeutic compositions may also, or alternatively, comprise T cells specific for a lung tumor protein. Such cells may generally be prepared in vitro or ex vivo, using standard procedures. For example, T cells may be isolated from bone marrow, peripheral blood, or a fraction of bone marrow or peripheral blood of a patient, using a commercially available cell separation system, such as the CEPRATE™ system, available from CellPro Inc., Bothell Wash. (see also U.S. Pat. No. 5,240,856; U.S. Pat. No. 5,215,926; WO 89/06280; WO 91/16116 and WO 92/07243). Alternatively, T cells may be derived from related or unrelated humans, non-human mammals, cell lines or cultures.

T cells may be stimulated with a lung tumor polypeptide, polynucleotide encoding a lung tumor polypeptide and/or an antigen presenting cell (APC) that expresses such a polypeptide. Such stimulation is performed under conditions and for a time sufficient to permit the generation of T cells that are specific for the polypeptide. Preferably, a lung tumor polypeptide or polynucleotide is present within a delivery vehicle, such as a microsphere, to facilitate the generation of specific T cells.

T cells are considered to be specific for a lung tumor polypeptide if the T cells kill target cells coated with the polypeptide or expressing a gene encoding the polypeptide. T cell specificity may be evaluated using any of a variety of standard techniques. For example, within a chromium release assay or proliferation assay, a stimulation index of more than two fold increase in lysis and/or proliferation, compared to negative controls, indicates T cell specificity. Such assays may be performed, for example, as described in Chen et al., Cancer Res. 54:1065–1070, 1994. Alternatively, detection of the proliferation of T cells may be accomplished by a variety of known techniques. For example, T cell proliferation can be detected by measuring an increased rate of DNA synthesis (e.g., by pulse-labeling cultures of T cells with tritiated thymidine and measuring the amount of tritiated thymidine incorporated into DNA). Contact with a lung tumor polypeptide (100 ng/ml–100 $\mu$g/ml, preferably 200 ng/ml–25 $\mu$g/ml) for 3–7 days should result in at least a two fold increase in proliferation of the T cells. Contact as described above for 2–3 hours should result in activation of the T cells, as measured using standard cytokine assays in which a two fold increase in the level of cytokine release (e.g., TNF or IFN-$\gamma$) is indicative of T cell activation (see Coligan et al., Current Protocols in Immunology, vol. 1, Wiley Interscience (Greene 1998)). T cells that have been activated in response to a lung tumor polypeptide, polynucleotide or polypeptide-expressing APC may be $CD4^+$ and/or $CD8^+$. Lung tumor protein-specific T cells may be expanded using standard techniques. Within preferred embodiments, the T cells are derived from either a patient or a related, or unrelated, donor and are administered to the patient following stimulation and expansion.

For therapeutic purposes, $CD4^+$ or $CD8^+$ T cells that proliferate in response to a lung tumor polypeptide, polynucleotide or APC can be expanded in number either in vitro or in vivo. Proliferation of such T cells in vitro may be accomplished in a variety of ways. For example, the T cells can be re-exposed to a lung tumor polypeptide, or a short peptide corresponding to an immunogenic portion of such a polypeptide, with or without the addition of T cell growth factors, such as interleukin-2, and/or stimulator cells that synthesize a lung tumor polypeptide. Alternatively, one or more T cells that proliferate in the presence of a lung tumor protein can be expanded in number by cloning. Methods for cloning cells are well known in the art, and include limiting dilution.

Pharmaceutical Compositions and Vaccines

Within certain aspects, polypeptides, polynucleotides, T cells and/or binding agents disclosed herein may be incorporated into pharmaceutical compositions or immunogenic compositions (i.e., vaccines). Pharmaceutical compositions comprise one or more such compounds and a physiologically acceptable carrier. Vaccines may comprise one or more such compounds and an immunostimulant. An immunostimulant may be any substance that enhances or potentiates an immune response to an exogenous antigen. Examples of immunostimulants include adjuvants, biodegradable microspheres (e.g., polylactic galactide) and liposomes (into which the compound is incorporated; see e.g., Fullerton, U.S. Pat. No. 4,235,877). Vaccine preparation is generally described in, for example, M. F. Powell and M. J. Newman, eds., "Vaccine Design (the subunit and adjuvant approach)," Plenum Press (NY, 1995). Pharmaceutical compositions and vaccines within the scope of the present invention may also contain other compounds, which may be biologically active or inactive. For example, one or more immunogenic portions of other tumor antigens may be present, either incorporated into a fusion polypeptide or as a separate compound, within the composition or vaccine.

A pharmaceutical composition or vaccine may contain DNA encoding one or more of the polypeptides as described above, such that the polypeptide is generated in situ. As noted above, the DNA may be present within any of a variety of delivery systems known to those of ordinary skill in the art, including nucleic acid expression systems, bacteria and viral expression systems. Numerous gene delivery techniques are well known in the art, such as those described by Rolland, *Crit. Rev. Therap. Drug Carrier Systems* 15:143–198, 1998, and references cited therein. Appropriate nucleic acid expression systems contain the necessary DNA sequences for expression in the patient (such as a suitable promoter and terminating signal). Bacterial delivery systems involve the administration of a bacterium (such as *Bacillus*-Calmette-Guerrin) that expresses an immunogenic portion of the polypeptide on its cell surface or secretes such an epitope. In a preferred embodiment, the DNA may be introduced using a viral expression system (e.g., vaccinia or other pox virus, retrovirus, or adenovirus), which may involve the use of a non-pathogenic (defective), replication competent virus. Suitable systems are disclosed, for example, in Fisher-Hoch et al., *Proc. Natl. Acad. Sci. USA* 86:317–321, 1989; Flexner et al., *Ann. N.Y. Acad. Sci.* 569:86–103, 1989; Flexner et al., *Vaccine* 8:17–21, 1990; U.S. Pat. Nos. 4,603,112, 4,769,330, and 5,017,487; WO 89/01973; U.S. Pat. No. 4,777,127; GB 2,200,651; EP 0,345,242; WO 91/02805; Berkner, *Biotechniques* 6:616–627, 1988; Rosenfeld et al., *Science* 252:431–434, 1991; Kolls et al., *Proc. Natl. Acad. Sci. USA* 91:215–219, 1994; Kass-Eisler et al., *Proc. Natl. Acad. Sci. USA* 90:11498–11502, 1993; Guzman et al., *Circulation* 88:2838–2848, 1993; and Guzman et al., *Cir. Res.* 73:1202–1207, 1993. Techniques for incorporating DNA into such expression systems are well known to those of ordinary skill in the art. The DNA may also be "naked," as described, for example, in Ulmer et al., *Science* 259:1745–1749, 1993 and reviewed by Cohen, *Science* 259:1691–1692, 1993. The uptake of naked DNA may be increased by coating the DNA onto biodegradable beads, which are efficiently transported into the cells.

While any suitable carrier known to those of ordinary skill in the art may be employed in the pharmaceutical compositions of this invention, the type of carrier will vary depending on the mode of administration. Compositions of the present invention may be formulated for any appropriate manner of administration, including for example, topical, oral, nasal, intravenous, intracranial, intraperitoneal, subcutaneous or intramuscular administration. For parenteral administration, such as subcutaneous injection, the carrier preferably comprises water, saline, alcohol, a fat, a wax or a buffer. For oral administration, any of the above carriers or a solid carrier, such as mannitol, lactose, starch, magnesium stearate, sodium saccharine, talcum, cellulose, glucose, sucrose, and magnesium carbonate, may be employed. Biodegradable microspheres (e.g., polylactate polyglycolate) may also be employed as carriers for the pharmaceutical compositions of this invention. Suitable biodegradable microspheres are disclosed, for example, in U.S. Pat. Nos. 4,897,268 and 5,075,109.

Such compositions may also comprise buffers (e.g., neutral buffered saline or phosphate buffered saline), carbohydrates (e.g., glucose, mannose, sucrose or dextrans), mannitol, proteins, polypeptides or amino acids such as glycine, antioxidants, chelating agents such as EDTA or glutathione, adjuvants (e.g., aluminum hydroxide) and/or preservatives. Alternatively, compositions of the present invention may be formulated as a lyophilizate. Compounds may also be encapsulated within liposomes using well known technology.

Any of a variety of immunostimulants may be employed in the vaccines of this invention. For example, an adjuvant may be included. Most adjuvants contain a substance designed to protect the antigen from rapid catabolism, such as aluminum hydroxide or mineral oil, and a stimulator of immune responses, such as lipid A, *Bortadella pertussis* or *Mycobacterium tuberculosis* derived proteins. Suitable adjuvants are commercially available as, for example, Freund's Incomplete Adjuvant and Complete Adjuvant (Difco Laboratories, Detroit, Mich.); Merck Adjuvant 65 (Merck and Company, Inc., Rahway, N.J.); AS-2 (SmithKline Beecham, Philadelphia, Pa.); aluminum salts such as aluminum hydroxide gel (alum) or aluminum phosphate; salts of calcium, iron or zinc; an insoluble suspension of acylated tyrosine; acylated sugars; cationically or anionically derivatized polysaccharides; polyphosphazenes; biodegradable microspheres; monophosphoryl lipid A and quil A. Cytokines, such as GM-CSF or interleukin-2, -7, or -12, may also be used as adjuvants.

Within the vaccines provided herein, the adjuvant composition is preferably designed to induce an immune response predominantly of the Th1 type. High levels of Th1-type cytokines (e.g., IFN-γ, TNFα, IL-2 and IL-12) tend to favor the induction of cell mediated immune responses to an administered antigen. In contrast, high levels of Th2-type cytokines (e.g., IL-4, IL-5, IL-6 and IL-10) tend to favor the induction of humoral immune responses. Following application of a vaccine as provided herein, a patient will support an immune response that includes Th1- and Th2-type responses. Within a preferred embodiment, in which a response is predominantly Th1-type, the level of Th1-type cytokines will increase to a greater extent than the level of Th2-type cytokines. The levels of these cytokines may be readily assessed using standard assays. For a review of the families of cytokines, see Mosmann and Coffinan, *Ann. Rev. Immunol.* 7:145–173, 1989.

Preferred adjuvants for use in eliciting a predominantly Th1-type response include, for example, a combination of monophosphoryl lipid A, preferably 3-de-O-acylated monophosphoryl lipid A (3D-MPL), together with an aluminum salt. MPL adjuvants are available from Ribi ImmunoChem Research Inc. (Hamilton, Mont.) (see U.S. Pat. Nos. 4,436, 727; 4,877,611; 4,866,034 and 4,912,094). CpG-containing oligonucleotides (in which the CpG dinucleotide is unmethylated) also induce a predominantly Th1 response. Such oligonucleotides are well known and are described, for example, in WO 96/02555 and WO 99/33488. Immunostimulatory DNA sequences are also described, for example, by Sato et al., *Science* 273:352, 1996. Another preferred adjuvant is a saponin, preferably QS21 (Aquila Biopharmaceuticals Inc., Framingham, Mass.), which may be used alone or in combination with other adjuvants. For example, an enhanced system involves the combination of a monophosphoryl lipid A and saponin derivative, such as the combination of QS21 and 3D-MPL as described in WO 94/00153, or a less reactogenic composition where the QS21 is quenched with cholesterol, as described in WO 96/33739. Other preferred formulations comprises an oil-in-water emulsion and tocopherol. A particularly potent adjuvant formulation involving QS21, 3D-MPL and tocopherol in an oil-in-water emulsion is described in WO 95/17210.

Other preferred adjuvants include Montanide ISA 720 (Seppic, France), SAF (Chiron, California, United States), ISCOMS (CSL), MF-59 (Chiron), the SBAS series of adjuvants (e.g., SBAS-2 or SBAS-4, available from SmithKline Beecham, Rixensart, Belgium), Detox (Ribi ImmunoChem Research Inc., Hamilton, Mont.), RC-529 (Ribi ImmunoChem Research Inc., Hamilton, Mont.) and Aminoalkyl glucosaminide 4-phosphates (AGPs).

Any vaccine provided herein may be prepared using well known methods that result in a combination of antigen, immune response enhancer and a suitable carrier or excipient. The compositions described herein may be administered as part of a sustained release formulation (i.e., a formulation such as a capsule, sponge or gel (composed of polysaccharides, for example) that effects a slow release of compound following administration). Such formulations may generally be prepared using well known technology (see, e.g. Coombes et al., *Vaccine* 14:1429–1438, 1996) and administered by, for example, oral, rectal or subcutaneous implantation, or by implantation at the desired target site. Sustained-release formulations may contain a polypeptide, polynucleotide or antibody dispersed in a carrier matrix and/or contained within a reservoir surrounded by a rate controlling membrane.

Carriers for use within such formulations are biocompatible, and may also be biodegradable; preferably the formulation provides a relatively constant level of active component release. Such carriers include microparticles of poly(lactide-co-glycolide), as well as polyacrylate, latex, starch, cellulose and dextran. Other delayed-release carriers include suprarnolecular biovectors, which comprise a nonliquid hydrophilic core (e.g., a cross-linked polysaccharide or oligosaccharide) and, optionally, an external layer comprising an amphiphilic compound, such as a phospholipid (see e.g., U.S. Pat. No. 5,151,254 and PCT applications WO 94/20078, WO/94/23701 and WO 96/06638). The amount of active compound contained within a sustained release formulation depends upon the site of implantation, the rate and expected duration of release and the nature of the condition to be treated or prevented.

Any of a variety of delivery vehicles may be employed within pharmaceutical compositions and vaccines to facilitate production of an antigen-specific immune response that targets tumor cells. Delivery vehicles include antigen presenting cells (APCs), such as dendritic cells, macrophages, B cells, monocytes and other cells that may bc engineered to be efficient APCs. Such cells may, but need not, be genetically modified to increase the capacity for presenting the antigen, to improve activation and/or maintenance of the T cell response, to have anti-tumor effects per se and/or to be immunologically compatible with the receiver (i.e., matched HLA haplotype). APCs may generally be isolated from any of a variety of biological fluids and organs, including tumor and peritumoral tissues, and may be autologous, allogeneic, syngeneic or xenogeneic cells.

Certain preferred embodiments of the present invention use dendritic cells or progenitors thereof as antigen-presenting cells. Dendritic cells are highly potent APCs (Banchereau and Steinman, *Nature* 392:245–251, 1998) and have been shown to be effective as a physiological adjuvant for eliciting prophylactic or therapeutic antitumor immunity (see Timmerman and Levy, *Ann. Rev. Med.* 50:507–529, 1999). In general, dendritic cells may be identified based on their typical shape (stellate in situ, with marked cytoplasmic processes (dendrites) visible in vitro), their ability to take up, process and present antigens with high efficiency, and their ability to activate naive T cell responses. Dendritic cells may, of course, be engineered to express specific cell-surface receptors or ligands that are not commonly found on dendritic cells in vivo or ex vivo, and such modified dendritic cells are contemplated by the present invention. As an alternative to dendritic cells, secreted vesicles antigen-loaded dendritic cells (called exosomes) may be used within a vaccine (see Zitvogel et al., *Nature Med.* 4:594–600, 1998).

Dendritic cells and progenitors may be obtained from peripheral blood, bone marrow, tumor-infiltrating cells, peritumoral tissues-infiltrating cells, lymph nodes, spleen, skin, umbilical cord blood or any other suitable tissue or fluid. For example, dendritic cells may be differentiated ex vivo by adding a combination of cytokines such as GM-CSF, IL-4, IL-13 and/or TNFα to cultures of monocytes harvested from peripheral blood. Alternatively, CD34 positive cells harvested from peripheral blood, umbilical cord blood or bone marrow may be differentiated into dendritic cells by adding to the culture medium combinations of GM-CSF, IL-3, TNFα, CD40 ligand, LPS, flt3 ligand and/or other compound(s) that induce differentiation, maturation and proliferation of dendritic cells.

Dendritic cells are conveniently categorized as "immature" and "mature" cells, which allows a simple way to discriminate between two well characterized phenotypes. However, this nomenclature should not be construed to exclude all possible intermediate stages of differentiation. Immature dendritic cells are characterized as APC with a high capacity for antigen uptake and processing, which correlates with the high expression of Fcγ receptor and mannose receptor. The mature phenotype is typically characterized by a lower expression of these markers, but a high expression of cell surface molecules responsible for T cell activation such as class I and class II MHC, adhesion molecules (e.g., CD54 and CD11) and costimulatory molecules (e.g., CD40, CD80, CD86 and 4-1BB).

APCs may generally be transfected with a polynucleotide encoding a lung tumor protein (or portion or other variant thereof) such that the lung tumor polypeptide, or an immunogenic portion thereof, is expressed on the cell surface. Such transfection may take place ex vivo, and a composition or vaccine comprising such transfected cells may then be used for therapeutic purposes, as described herein. Alternatively, a gene delivery vehicle that targets a dendritic or other antigen presenting cell may be administered to a patient, resulting in transfection that occurs in vivo. In vivo and ex vivo transfection of dendritic cells, for example, may generally be performed using any methods known in the art, such as those described in WO 97/24447, or the gene gun approach described by Mahvi et al., *Immunology and cell Biology* 75:456–460, 1997. Antigen loading of dendritic cells may be achieved by incubating dendritic cells or progenitor cells with the lung tumor polypeptide, DNA (naked or within a plasmid vector) or RNA; or with antigen-expressing recombinant bacterium or viruses (e.g., vaccinia, fowlpox, adenovirus or lentivirus vectors). Prior to loading, the polypeptide may be covalently conjugated to an immunological partner that provides T cell help (e.g., a carrier molecule). Alternatively, a dendritic cell may be pulsed with a non-conjugated immunological partner, separately or in the presence of the polypeptide.

Vaccines and pharmaceutical compositions may be presented in unit-dose or multi-dose containers, such as sealed ampoules or vials. Such containers are preferably hermetically sealed to preserve sterility of the formulation until use. In general, formulations may be stored as suspensions, solutions or emulsions in oily or aqueous vehicles. Alternatively, a vaccine or pharmaceutical composition may be stored in a freeze-dried condition requiring only the addition of a sterile liquid carrier immediately prior to use.

Cancer Therapy

In further aspects of the present invention, the compositions described herein may be used for immunotherapy of cancer, such as lung cancer. Within such methods, pharmaceutical compositions and vaccines are typically administered to a patient. As used herein, a "patient" refers to any warm-blooded animal, preferably a human. A patient may or may not be afflicted with cancer. Accordingly, the above pharmaceutical compositions and vaccines may be used to prevent the development of a cancer or to treat a patient afflicted with a cancer. A cancer may be diagnosed using criteria generally accepted in the art, including the presence of a malignant tumor. Pharmaceutical compositions and vaccines may be administered either prior to or following surgical removal of primary tumors and/or treatment such as administration of radiotherapy or conventional chemotherapeutic drugs.

Within certain embodiments, immunotherapy may be active immunotherapy, in which treatment relies on the in vivo stimulation of the endogenous host immune system to react against tumors with the administration of immune response-modifying agents (such as polypeptides and polynucleotides disclosed herein).

Within other embodiments, immunotherapy may be passive immunotherapy, in which treatment involves the delivery of agents with established tumor-immune reactivity (such as effector cells or antibodies) that can directly or indirectly mediate antitumor effects and does not necessarily depend on an intact host immune system. Examples of effector cells include T cells as discussed above, T lymphocytes (such as $CD8^+$ cytotoxic T lymphocytes and $CD4^+$ T-helper tumor-infiltrating lymphocytes), killer cells (such as Natural Killer cells and lymphokine-activated killer cells), B cells and antigen-presenting cells (such as dendritic cells and macrophages) expressing a polypeptide provided herein. T cell receptors and antibody receptors specific for the polypeptides recited herein may be cloned, expressed and transferred into other vectors or effector cells for adoptive immunotherapy. The polypeptides provided herein may also be used to generate antibodies or anti-idiotypic antibodies (as described above and in U.S. Pat. No. 4,918,164) for passive immunotherapy.

Effector cells may generally be obtained in sufficient quantities for adoptive immunotherapy by growth in vitro, as described herein. Culture conditions for expanding single antigen-specific effector cells to several billion in number with retention of antigen recognition in vivo are well known in the art. Such in vitro culture conditions typically use intermittent stimulation with antigen, often in the presence of cytokines (such as IL-2) and non-dividing feeder cells. As noted above, immunoreactive polypeptides as provided herein may be used to rapidly expand antigen-specific T cell cultures in order to generate a sufficient number of cells for immunotherapy. In particular, antigen-presenting cells, such as dendritic, macrophage or B cells, may be pulsed with immunoreactive polypeptides or transfected with one or more polynucleotides using standard techniques well known in the art. For example, antigen-presenting cells can be transfected with a polynucleotide having a promoter appropriate for increasing expression in a recombinant virus or other expression system. Cultured effector cells for use in therapy must be able to grow and distribute widely, and to survive long term in vivo. Studies have shown that cultured effector cells can be induced to grow in vivo and to survive long term in substantial numbers by repeated stimulation with antigen supplemented with IL-2 (see, for example, Cheever et al., *Immunological Reviews* 157:177, 1997).

Alternatively, a vector expressing a polypeptide recited herein may be introduced into antigen presenting cells taken from a patient and clonally propagated ex vivo for transplant back into the same patient. Transfected cells may be reintroduced into the patient using any means known in the art, preferably in sterile form by intravenous, intracavitary, intraperitoneal or intratumor administration.

Routes and frequency of administration of the therapeutic compositions disclosed herein, as well as dosage, will vary from individual to individual, and may be readily established using standard techniques. In general, the pharmaceutical compositions and vaccines may be administered by injection (e.g., intracutaneous, intramuscular, intravenous or subcutaneous), intranasally (e.g., by aspiration) or orally. Preferably, between 1 and 10 doses may be administered over a 52 week period. Preferably, 6 doses are administered, at intervals of 1 month, and booster vaccinations may be given periodically thereafter. Alternate protocols may be appropriate for individual patients. A suitable dose is an amount of a compound that, when administered as described above, is capable of promoting an anti-tumor immune response, and is at least 10–50% above the basal (i.e., untreated) level. Such response can be monitored by measuring the anti-tumor antibodies in a patient or by vaccine-dependent generation of cytolytic effector cells capable of killing the patient's tumor cells in vitro. Such vaccines should also be capable of causing an immune response that leads to an improved clinical outcome (e.g., more frequent remissions, complete or partial or longer disease-free survival) in vaccinated patients as compared to non-vaccinated patients. In general, for pharmaceutical compositions and vaccines comprising one or more polypeptides, the amount of each polypeptide present in a dose ranges from about 25 µg to 5 mg per kg of host. Suitable dose sizes will vary with the size of the patient, but will typically range from about 0.1 mL to about 5 mL.

In general, an appropriate dosage and treatment regimen provides the active compound(s) in an amount sufficient to provide therapeutic and/or prophylactic benefit. Such a response can be monitored by establishing an improved clinical outcome (e.g., more frequent remissions, complete or partial, or longer disease-free survival) in treated patients as compared to non-treated patients. Increases in preexisting immune responses to a lung tumor protein generally correlate with an improved clinical outcome. Such immune responses may generally be evaluated using standard proliferation, cytotoxicity or cytokine assays, which may be performed using samples obtained from a patient before and after treatment.

Methods for Detecting Cancer

In general, a cancer may be detected in a patient based on the presence of one or more lung tumor proteins, and/or polynucleotides encoding such proteins, in a biological sample (for example, blood, sera, urine, sputum and/or tumor biopsies) obtained from the patient. In other words, such proteins may be used as markers to indicate the presence or absence of a cancer such as lung cancer. In addition, such proteins may be useful for the detection of other cancers. The binding agents provided herein generally permit detection of the level of antigen that binds to the agent in the biological sample. Polynucleotide primers and probes may be used to detect the level of mRNA encoding a tumor protein, which is also indicative of the presence or absence of a cancer. In general, a lung tumor sequence should be present at a level that is at least three fold higher in tumor tissue than in normal tissue.

There are a variety of assay formats known to those of ordinary skill in the art for using a binding agent to detect polypeptide markers in a sample. See, e.g., Harlow and Lane, *Antibodies: A Laboratory Manual*, Cold Spring Harbor Laboratory, 1988. In general, the presence or absence of a cancer in a patient may be determined by (a) contacting a biological sample obtained from a patient with a binding agent; (b) detecting in the sample a level of polypeptide that binds to the binding agent; and (c) comparing the level of polypeptide with a predetermined cut-off value.

In a preferred embodiment, the assay involves the use of binding agent immobilized on a solid support to bind to and remove the polypeptide from the remainder of the sample. The bound polypeptide may then be detected using a detection reagent that contains a reporter group and specifically binds to the binding agent/polypeptide complex. Such detection reagents may comprise, for example, a binding agent that specifically binds to the polypeptide or an antibody or other agent that specifically binds to the binding agent, such as an anti-immunoglobulin, protein G, protein A or a lectin. Alternatively, a competitive assay may be utilized, in which a polypeptide is labeled with a reporter group and allowed to bind to the immobilized binding agent after incubation of the binding agent with the sample. The extent to which components of the sample inhibit the binding of the labeled polypeptide to the binding agent is indicative of the reactivity of the sample with the immobilized binding agent. Suitable polypeptides for use within such assays include full length lung tumor proteins and portions thereof to which the binding agent binds, as described above.

The solid support may be any material known to those of ordinary skill in the art to which the tumor protein may be attached. For example, the solid support may be a test well in a microtiter plate or a nitrocellulose or other suitable membrane. Alternatively, the support may be a bead or disc, such as glass, fiberglass, latex or a plastic material such as polystyrene or polyvinylchloride. The support may also be a magnetic particle or a fiber optic sensor, such as those disclosed, for example, in U.S. Pat. No. 5,359,681. The binding agent may be immobilized on the solid support using a variety of techniques known to those of skill in the art, which are amply described in the patent and scientific literature. In the context of the present invention, the term "immobilization" refers to both noncovalent association, such as adsorption, and covalent attachment (which may be a direct linkage between the agent and functional groups on the support or may be a linkage by way of a cross-linking agent). Immobilization by adsorption to a well in a microtiter plate or to a membrane is preferred. In such cases, adsorption may be achieved by contacting the binding agent, in a suitable buffer, with the solid support for a suitable amount of time. The contact time varies with temperature, but is typically between about 1 hour and about 1 day. In general, contacting a well of a plastic microtiter plate (such as polystyrene or polyvinylchloride) with an amount of binding agent ranging from about 10 ng to about 10 $\mu$g, and preferably about 100 ng to about 1 $\mu$g, is sufficient to immobilize an adequate amount of binding agent.

Covalent attachment of binding agent to a solid support may generally be achieved by first reacting the support with a bifunctional reagent that will react with both the support and a functional group, such as a hydroxyl or amino group, on the binding agent. For example, the binding agent may be covalently attached to supports having an appropriate polymer coating using benzoquinone or by condensation of an aldehyde group on the support with an amine and an active hydrogen on the binding partner (see, e.g., Pierce Immunotechnology Catalog and Handbook, 1991, at A12–A13).

In certain embodiments, the assay is a two-antibody sandwich assay. This assay may be performed by first contacting an antibody that has been immobilized on a solid support, commonly the well of a microtiter plate, with the sample, such that polypeptides within the sample are allowed to bind to the immobilized antibody. Unbound sample is then removed from the immobilized polypeptide-antibody complexes and a detection reagent (preferably a second antibody capable of binding to a different site on the polypeptide) containing a reporter group is added. The amount of detection reagent that remains bound to the solid support is then determined using a method appropriate for the specific reporter group.

More specifically, once the antibody is immobilized on the support as described above, the remaining protein binding sites on the support are typically blocked. Any suitable blocking agent known to those of ordinary skill in the art, such as bovine serum albumin or Tween 20™ (Sigma Chemical Co., St. Louis, Mo.). The immobilized antibody is then incubated with the sample, and polypeptide is allowed to bind to the antibody. The sample may be diluted with a suitable diluent, such as phosphate-buffered saline (PBS) prior to incubation. In general, an appropriate contact time (i.e., incubation time) is a period of time that is sufficient to detect the presence of polypeptide within a sample obtained from an individual with lung cancer. Preferably, the contact time is sufficient to achieve a level of binding that is at least about 95% of that achieved at equilibrium between bound and unbound polypeptide. Those of ordinary skill in the art will recognize that the time necessary to achieve equilibrium may be readily determined by assaying the level of binding that occurs over a period of time. At room temperature, an incubation time of about 30 minutes is generally sufficient.

Unbound sample may then be removed by washing the solid support with an appropriate buffer, such as PBS containing 0.1% Tween 20™. The second antibody, which contains a reporter group, may then be added to the solid support. Preferred reporter groups include those groups recited above.

The detection reagent is then incubated with the immobilized antibody-polypeptide complex for an amount of time sufficient to detect the bound polypeptide. An appropriate amount of time may generally be determined by assaying the level of binding that occurs over a period of time. Unbound detection reagent is then removed and bound detection reagent is detected using the reporter group. The method employed for detecting the reporter group depends upon the nature of the reporter group. For radioactive groups, scintillation counting or autoradiographic methods are generally appropriate. Spectroscopic methods may be used to detect dyes, luminescent groups and fluorescent groups. Biotin may be detected using avidin, coupled to a different reporter group (commonly a radioactive or fluorescent group or an enzyme). Enzyme reporter groups may generally be detected by the addition of substrate (generally for a specific period of time), followed by spectroscopic or other analysis of the reaction products.

To determine the presence or absence of a cancer, such as lung cancer, the signal detected from the reporter group that remains bound to the solid support is generally compared to a signal that corresponds to a predetermined cut-off value. In one preferred embodiment, the cut-off value for the detection of a cancer is the average mean signal obtained when the immobilized antibody is incubated with samples from patients without the cancer. In general, a sample generating a signal that is three standard deviations above the predetermined cut-off value is considered positive for the cancer. In an alternate preferred embodiment, the cut-off value is determined using a Receiver Operator Curve, according to the method of Sackett et al., *Clinical Epidemiology: A Basic Science for Clinical Medicine*, Little Brown and Co., 1985, p. 106–7. Briefly, in this embodiment, the cut-off value may be determined from a plot of pairs of true positive rates (i.e., sensitivity) and false positive rates (100%-specificity) that correspond to each possible cut-off value for the diagnostic test result. The cut-off value on the plot that is the closest to the upper left-hand corner (i.e., the value that encloses the largest area) is the most accurate cut-off value, and a sample generating a signal that is higher than the cut-off value determined by this method may be considered positive. Alternatively, the cut-off value may be shifted to the left along the plot, to minimize the false positive rate, or to the right, to minimize the false negative rate. In general, a sample generating a signal that is higher than the cut-off value determined by this method is considered positive for a cancer.

In a related embodiment, the assay is performed in a flow-through or strip test format, wherein the binding agent is immobilized on a membrane, such as nitrocellulose. In the flow-through test, polypeptides within the sample bind to the immobilized binding agent as the sample passes through the membrane. A second, labeled binding agent then binds to the binding agent-polypeptide complex as a solution containing the second binding agent flows through the membrane. The detection of bound second binding agent may then be performed as described above. In the strip test format, one end of the membrane to which binding agent is bound is immersed in a solution containing the sample. The sample migrates along the membrane through a region containing second binding agent and to the area of immobilized binding agent. Concentration of second binding agent at the area of immobilized antibody indicates the presence of a cancer. Typically, the concentration of second binding agent at that site generates a pattern, such as a line, that can be read visually. The absence of such a pattern indicates a negative result. In general, the amount of binding agent immobilized on the membrane is selected to generate a visually discernible pattern when the biological sample contains a level of polypeptide that would be sufficient to generate a positive signal in the two-antibody sandwich assay, in the format discussed above. Preferred binding agents for use in such assays are antibodies and antigen-binding fragments thereof. Preferably, the amount of antibody immobilized on the membrane ranges from about 25 ng to about 1 $\mu$g, and more preferably from about 50 ng to about 500 ng. Such tests can typically be performed with a very small amount of biological sample.

Of course, numerous other assay protocols exist that are suitable for use with the tumor proteins or binding agents of the present invention. The above descriptions are intended to be exemplary only. For example, it will be apparent to those of ordinary skill in the art that the above protocols may be readily modified to use lung tumor polypeptides to detect antibodies that bind to such polypeptides in a biological sample. The detection of such lung tumor protein specific antibodies may correlate with the presence of a cancer.

A cancer may also, or alternatively, be detected based on the presence of T cells that specifically react with a lung tumor protein in a biological sample. Within certain methods, a biological sample comprising CD4$^+$ and/or CD8$^+$ T cells isolated from a patient is incubated with a lung tumor polypeptide, a polynucleotide encoding such a polypeptide and/or an APC that expresses at least an immunogenic portion of such a polypeptide, and the presence or absence of specific activation of the T cells is detected. Suitable biological samples include, but are not limited to, isolated T cells. For example, T cells may be isolated from a patient by routine techniques (such as by Ficoll/Hypaque density gradient centrifugation of peripheral blood lymphocytes). T cells may be incubated in vitro for 2–9 days (typically 4 days) at 37° C. with Mtb-81 or Mtb-67.2 polypeptide (e.g., 5–25 $\mu$g/ml). It may be desirable to incubate another aliquot of a T cell sample in the absence of lung tumor polypeptide to serve as a control. For CD4$^+$ T cells, activation is preferably detected by evaluating proliferation of the T cells. For CD8$^+$ T cells, activation is preferably detected by evaluating cytolytic activity. A level of proliferation that is at least two fold greater and/or a level of cytolytic activity that is at least 20% greater than in disease-free patients indicates the presence of a cancer in the patient.

As noted above, a cancer may also, or alternatively, be detected based on the level of mRNA encoding a lung tumor protein in a biological sample. For example, at least two oligonucleotide primers may be employed in a polymerase chain reaction (PCR) based assay to amplify a portion of a lung tumor cDNA derived from a biological sample, wherein at least one of the oligonucleotide primers is specific for (i.e., hybridizes to) a polynucleotide encoding the lung tumor protein. The amplified cDNA is then separated and detected using techniques well known in the art, such as gel electrophoresis. Similarly, oligonucleotide probes that specifically hybridize to a polynucleotide encoding a lung tumor protein may be used in a hybridization assay to detect the presence of polynucleotide encoding the tumor protein in a biological sample.

To permit hybridization under assay conditions, oligonucleotide primers and probes should comprise an oligonucleotide sequence that has at least about 60%, preferably at least about 75% and more preferably at least about 90%, identity to a portion of a polynucleotide encoding a lung tumor protein that is at least 10 nucleotides, and preferably at least 20 nucleotides, in length. Preferably, oligonucleotide primers and/or probes will hybridize to a polynucleotide encoding a polypeptide disclosed herein under moderately stringent conditions, as defined above. Oligonucleotide primers and/or probes which may be usefully employed in the diagnostic methods described herein preferably are at least 10–40 nucleotides in length. In a preferred embodiment, the oligonucleotide primers comprise at least 10 contiguous nucleotides, more preferably at least 15 contiguous nucleotides, of a DNA molecule having a sequence recited in SEQ ID NO: 1–782, 784, 785 and 788. Techniques for both PCR based assays and hybridization assays are well known in the art (see, for example, Mullis et al., *Cold Spring Harbor Symp. Quant. Biol.*, 51:263, 1987; Erlich ed., *PCR Technology*, Stockton Press, NY, 1989).

One preferred assay employs RT-PCR, in which PCR is applied in conjunction with reverse transcription. Typically, RNA is extracted from a biological sample, such as biopsy tissue, and is reverse transcribed to produce cDNA molecules. PCR amplification using at least one specific primer generates a cDNA molecule, which may be separated and visualized using, for example, gel electrophoresis. Amplification may be performed on biological samples taken from a test patient and from an individual who is not afflicted with a cancer. The amplification reaction may be performed on several dilutions of cDNA spanning two orders of magnitude. A two-fold or greater increase in expression in several dilutions of the test patient sample as compared to the same dilutions of the non-cancerous sample is typically considered positive.

In another embodiment, the disclosed compositions may be used as markers for the progression of cancer. In this embodiment, assays as described above for the diagnosis of a cancer may be performed over time, and the change in the level of reactive polypeptide(s) or polynucleotide evaluated. For example, the assays may be performed every 24–72 hours for a period of 6 months to 1 year, and thereafter performed as needed. In general, a cancer is progressing in those patients in whom the level of polypeptide or polynucleotide detected increases over time. In contrast, the cancer is not progressing when the level of reactive polypeptide or polynucleotide either remains constant or decreases with time.

Certain in vivo diagnostic assays may be performed directly on a tumor. One such assay involves contacting tumor cells with a binding agent. The bound binding agent may then be detected directly or indirectly via a reporter group. Such binding agents may also be used in histological applications. Alternatively, polynucleotide probes may be used within such applications.

As noted above, to improve sensitivity, multiple lung tumor protein markers may be assayed within a given sample. It will be apparent that binding agents specific for different proteins provided herein may be combined within a single assay. Further, multiple primers or probes may be used concurrently. The selection of tumor protein markers may be based on routine experiments to determine combinations that results in optimal sensitivity. In addition, or alternatively, assays for tumor proteins provided herein may be combined with assays for other known tumor antigens.

Diagnostic Kits

The present invention further provides kits for use within any of the above diagnostic methods. Such kits typically comprise two or more components necessary for performing a diagnostic assay. Components may be compounds, reagents, containers and/or equipment. For example, one container within a kit may contain a monoclonal antibody or fragment thereof that specifically binds to a lung tumor protein. Such antibodies or fragments may be provided attached to a support material, as described above. One or more additional containers may enclose elements, such as reagents or buffers, to be used in the assay. Such kits may also, or alternatively, contain a detection reagent as described above that contains a reporter group suitable for direct or indirect detection of antibody binding.

Alternatively, a kit may be designed to detect the level of mRNA encoding a lung tumor protein in a biological sample. Such kits generally comprise at least one oligonucleotide probe or primer, as described above, that hybridizes to a polynucleotide encoding a lung tumor protein. Such an oligonucleotide may be used, for example, within a PCR or hybridization assay. Additional components that may be present within such kits include a second oligonucleotide and/or a diagnostic reagent or container to facilitate the detection of a polynucleotide encoding a lung tumor protein.

The following Examples are offered by way of illustration and not by way of limitation.

EXAMPLE 1

Identification and Characterization of Lung Tumor Protein cDNAs

This Example illustrates the identification of cDNA molecules encoding lung tumor proteins.

A. Isolation of cDNA Sequences from Lung Adenocarcinoma Libraries Using Conventional cDNA Library Subtraction A human lung adenocarcinoma cDNA expression library was constructed from poly A$^+$ RNA from patient tissues (#40031486) using a Superscript Plasmid System for cDNA Synthesis and Plasmid Cloning kit (BRL Life Technologies, Gaithersburg, Md.) following the manufacturer's protocol. Specifically, lung carcinoma tissues were homogenized with polytron (Kinematica, Switzerland) and total RNA was extracted using Trizol reagent (BRL Life Technologies) as directed by the manufacturer. The poly A$^+$ RNA was then purified using an oligo dT cellulose column as described in Sambrook et al., *Molecular Cloning: A Laboratory Manual*, Cold Spring Harbor Laboratories, Cold Spring Harbor, N.Y., 1989. First-strand cDNA was synthesized using the NotI/Oligo-dT18 primer. Double-stranded cDNA was synthesized, ligated with BstXI/EcoRI adaptors (Invitrogen, San Diego, Calif.) and digested with NotI. Following size fractionation with cDNA size fractionation columns (BRL Life Technologies), the cDNA was ligated into the BstXI/NotI site of pcDNA3.1 (Invitrogen) and transformed into ElectroMax *E. coli* DH10B cells (BRL Life Technologies) by electroporation. A total of 3×10$^6$ independent colonies were generated.

Using the same procedure, a normal human cDNA expression library was prepared from a panel of normal tissue specimens, including lung, liver, pancreas, skin, kidney, brain and resting PBMC.

cDNA library subtraction was performed using the above lung adenocarcinoma and normal tissue cDNA libraries, as described by Hara et al. (*Blood*, 84:189–199, 1994) with some modifications. Specifically, a lung adenocarcinoma-specific subtracted cDNA library was generated as follows. The normal tissue cDNA library (80 µg) was digested with BamHI and XhoI, followed by a filling-in reaction with DNA polymerase Klenow fragment. After phenol-chloroform extraction and ethanol precipitation, the DNA was dissolved in 133 µl of H$_2$O, heat-denatured and mixed with 133 µl (133 µg) of Photoprobe biotin (Vector Laboratories, Burlingame, Calif.). As recommended by the manufacturer, the resulting mixture was irradiated with a 270 W sunlamp on ice for 20 minutes. Additional Photoprobe biotin (67 µl) was added and the biotinylation reaction was repeated. After extraction with butanol five times, the DNA was ethanol-precipitated and dissolved in 23 µl H$_2$O. The resulting DNA, plus other highly redundant cDNA clones that were frequently recovered in previous lung subtractions formed the driver DNA.

To form the tracer DNA, 10 µg lung adenocarcinoma cDNA library was digested with NotI and SpeI, phenol chloroform extracted and passed through Chroma spin-400 columns (Clontech, Palo Alto, Calif.). Typically, 5 µg of cDNA was recovered after the sizing column. Following ethanol precipitation, the tracer DNA was dissolved in 5 µl H$_2$O. Tracer DNA was mixed with 15 µl driver DNA and 20 µl of 2× hybridization buffer (1.5 M NaCl/10 mM EDTA/50 mM HEPES pH 7.5/0.2% sodium dodecyl sulfate), overlaid with mineral oil, and heat-denatured completely. The sample was immediately transferred into a 68° C. water bath and incubated for 20 hours (long hybridization [LH]). The reaction mixture was then subjected to a streptavidin treatment followed by phenol/chloroform extraction. This process was repeated three more times. Subtracted DNA was precipitated, dissolved in 12 µl H$_2$O, mixed with 8 µl driver DNA and 20 µl of 2× hybridization buffer, and subjected to a hybridization at 68° C. for 2 hours (short hybridization [SH]). After removal of biotinylated double-stranded DNA, subtracted cDNA was ligated into NotI/SpeI site of chloramphenicol resistant pBCSK$^+$ (Stratagene, La Jolla, Calif.) and transformed into ElectroMax *E. coli* DH10B cells by electroporation to generate a lung adenocarcinoma specific subtracted cDNA library, referred to as LAT-S1. Similarly, LAT-S2 was generated by including 23 genes that were over-expressed in the tracer as additional drivers.

A second human lung adenocarcinoma cDNA expression library was constructed using adenocarcinoma tissue from a second patient (#86–66) and used to prepare a second lung adenocarcinoma-specific subtracted cDNA library (referred to as LAT2-S2), as described above, using the same panel of normal tissues and the additional genes over-expressed in LAT-S1.

A third human metastatic lung adenocarcinoma library was constructed from a pool of two lung pleural effusions with lung and gastric adenocarcinoma origins. The subtracted cDNA library, Mets-sub2 was generated as described above using the same panel of normal tissues. However, the Mets-sub3 subtracted library was constructed by including 51 additional genes as drivers. These 51 genes were recovered in Mets-sub2, representing over-expressed housekeeping genes in the testers. As a result, Mets-sub3 is more complexed and normalized.

A total of 16 cDNA fragments isolated from LAT-S1, 585 cDNA fragments isolated from LAT-S2, 568 cDNA clones from LAT2-S2, 15 cDNA clones from Mets-sub2 and 343 cDNA clones from Mets-sub3, described above, were colony PCR amplified and their mRNA expression levels in lung tumor, normal lung, and various other normal and tumor tissues were determined using microarray technology (Incyte, Palo Alto, Calif.). Briefly, the PCR amplification products were dotted onto slides in an array format, with each product occupying a unique location in the array. mRNA was extracted from the tissue sample to be tested, reverse transcribed, and fluorescent-labeled cDNA probes were generated. The microarrays were probed with the labeled cDNA probes, the slides scanned and fluorescence intensity was measured. This intensity correlates with the hybridization intensity. Seventy-three non-redundant cDNA clones, of which 42 were found to be unique, showed over-expression in lung tumors, with expression in normal tissues tested (lung, skin, lymph node, colon, liver, pancreas, breast, heart, bone marrow, large intestine, kidney, stomach, brain, small intestine, bladder and salivary gland) being either undetectable, or at significantly lower levels compared to lung adenocarcinoma tumors. These clones were further characterized by DNA sequencing with a Perkin Elmer/Applied Biosystems Division Automated Sequencer Model 373A and/or Model 377 (Foster City, Calif.).

The sequences were compared to known sequences in the gene bank using the EMBL GenBank databases (release 96). No significant homologies were found to the sequence provided in SEQ ID NO: 67, with no apparent homology to previously identified expressed sequence tags (ESTs). The sequences of SEQ ID NO: 60, 62, 65, 66, 69–71, 74, 76, 79, 80, 84, 86, 89–92, 95, 97 and 98 were found to show some homology to previously identified expressed sequence tags (ESTs). The cDNA sequences of SEQ ID NO: 59, 61, 63, 64, 67, 68, 72, 73, 75, 77, 78, 81–83, 85, 87, 88, 93, 94, 96, 99 and 100 showed homology to previously identified genes. The full-length cDNA sequences for the clones of SEQ ID NO: 96 and 100 are provided in SEQ ID NO: 316 and 318, respectively. The amino acid sequences for the clones of SEQ ID NO: 59, 61, 63, 64, 68, 73, 82, 83, 94, 96 and 100 are provided in SEQ ID NO: 331, 328, 329, 332, 327, 333, 330, 326, 325, 324 and 335, respectively. A predicted amino acid sequence encoded by the sequence of SEQ ID NO: 69 (referred to as L552S) is provided in SEQ ID NO: 786.

The gene of SEQ ID NO: 84 (referred to as L551S) was determined by real-time RT-PCR analysis to be over-expressed in 2/9 primary adenocarcinomas and to be expressed at lower levels in 2/2 metastatic adenocarcinomas and 1/2 squamous cell carcinomas. No expression was observed in normal tissues, with the exception of very low expression in normal stomach.

B. Isolation of cDNA Sequences from Lung Adenocarcinoma Libraries Using PCR-based cDNA Library Subtraction cDNA clones from a PCR-based subtraction library, containing cDNA from a pool of two human lung primary adenocarcinomas subtracted against a pool of nine normal human tissue cDNAs including skin, colon, lung, esophagus, brain, kidney, spleen, pancreas and liver, (Clontech, Palo Alto, Calif.) were derived and submitted to a first round of PCR amplification. This library (referred to as ALT-1) was subjected to a second round of PCR amplification, following the manufacturer's protocol. The expression levels of 760 cDNA clones in lung tumor, normal lung, and various other normal and tumor tissues, were examined using microarray technology as described above. A total of 118 clones, of which 55 were unique, were found to be over-expressed in lung tumor tissue, with expression in normal tissues tested (lung, skin, lymph node, colon, liver, pancreas, breast, heart, bone marrow, large intestine, kidney, stomach, brain, small intestine, bladder and salivary gland) being either undetectable,.or at significantly lower levels. The sequences were compared to known sequences in the gene bank using the EMBL and GenBank databases (release 96). No significant homologies (including ESTs) were found to the sequence provided in SEQ ID NO: 44. The sequences of SEQ ID NO: 1, 11, 13, 15, 20, 23–27, 29, 30, 33, 34, 39, 41, 43, 45, 46, 51 and 57 were found to show some homology to previously identified expressed sequence tags (ESTs). The cDNA sequences of SEQ ID NO: 2–10, 12, 14, 16–19, 21, 22, 28, 31, 32, 35–38, 40, 42, 44, 47–50, 52–56 and 58 showed homology to previously identified genes. The full-length cDNA sequences for the clones of SEQ ID NO: 18, 22, 31, 35, 36 and 42 are provided in SEQ ID NO: 320, 319, 323, 321, 317, 321 and 322, respectively, with the corresponding amino acid sequences being provided in SEQ ID NO: 337, 336, 340, 338, 334, and 339, respectively. The predicted amino acid sequence encoded by the sequence of SEQ ID NO: 46 (referred to as L840P) is provided in SEQ ID NO: 787. The full-length cDNA sequence for the clone of SEQ ID NO: 54 (referred to as L548S) is provided in SEQ ID NO: 788, with the corresponding amino acid sequence being provided in SEQ ID NO: 789.

Northern blot analyses of the genes of SEQ ID NO: 25 and 46 (referred to as L839P and L840P, respectively) were remarkably similar. Both genes were expressed in 1/2 lung adenocarcinomas as two bands of 3.6 kb and 1.6 kb. No expression of L839P was observed in normal lung or trachea. No expression of L840P was observed in normal bone marrow, resting or activated PBMC, esophagus, or normal lung. Given the similar expression patterns, L839P and L840P may be derived from the same gene.

Additional lung adenocarcinoma cDNA clones were isolated as follows. A cDNA library was prepared from a pool of two lung adenocarcinomas and subtracted against cDNA from a panel of normal tissues including lung, brain, liver, kidney, pancreas, skin, heart and spleen. The subtraction was performed using a PCR-based protocol (Clontech), which was modified to generate larger fragments. Within this protocol, tester and driver double stranded cDNA were separately digested with five restriction enzymes that recognize six-nucleotide restriction sites (MluI, MscI, PvuII, SalI and StuI). This digestion resulted in an average cDNA size of 600 bp, rather than the average size of 300 bp that results from digestion with RsaI according to the Clontech protocol. The ends of the restriction digested tester cDNA were filled in to generate blunt ends for adapter ligation. This modification did not affect the subtraction efficiency. Two tester populations were then created with different adapters, and the driver library remained without adapters. The tester and driver libraries were then hybridized using excess driver cDNA. In the first hybridization step, driver was separately hybridized with each of the two tester cDNA populations. This resulted in populations of (a) unhybridized tester cDNAs, (b) tester cDNAs hybridized to other tester cDNAs, (c) tester cDNAs hybridized to driver cDNAs and (d) unhybridized driver cDNAs. The two separate hybridization reactions were then combined, and rehybridized in the presence of additional denatured driver cDNA. Following this second hybridization, in addition to populations (a) through (d), a fifth population (e) was generated in which tester cDNA with one adapter hybridized to tester cDNA with the second adapter. Accordingly, the second hybridization step resulted in enrichment of differentially expressed sequences which could be used as templates for PCR amplification with adaptor-specific primers.

The ends were then filled in, and PCR amplification was performed using adaptor-specific primers. Only population (e), which contained tester cDNA that did not hybridize to driver cDNA, was amplified exponentially. A second PCR amplification step was then performed, to reduce background and further enrich differentially expressed sequences.

Fifty-seven cDNA clones were isolated from the subtracted library (referred to as LAP1) and sequenced. The determined cDNA sequences for 16 of these clones are provided in SEQ ID NO: 101–116. The sequences of SEQ ID NO: 101 and 114 showed no significant homologies to previously identified sequences. The sequences of SEQ ID NO: 102–109 and 112 showed some similarity to previously identified sequences, while the sequences of SEQ ID NO: 113, 115 and 116 showed some similarity to previously isolated ESTs.

C. Isolation of cDNA Sequences from Small Cell Lung Carcinoma Libraries Using PCR-based cDNA Library Subtraction A subtracted cDNA library for small cell lung carcinoma (referred to as SCL1) was prepared using essentially the modified PCR-based subtraction process described above. cDNA from small cell lung carcinoma was subtracted against cDNA from a panel of normal tissues, including normal lung, brain, kidney, liver, pancreas, skin, heart, lymph node and spleen. Both tester and driver poly A+ RNA were initially amplified using SMART PCR cDNA synthesis kit (Clontech, Palo Alto, Calif.). The tester and driver double stranded cDNA were separately digested with five restriction enzymes (DraI, MscI, PvuII, SmaI, and StuI). These restriction enzymes generated blunt end cuts and the digestion resulted in an average insert size of 600 bp. Digestion with this set of restriction enzymes eliminates the step required to generate blunt ends by filling in of the cDNA ends. These modifications did not affect subtraction efficiency.

Eighty-five clones were isolated and sequenced. The determined cDNA sequences for 31 of these clones are provided in SEQ ID NO: 117–147. The sequences of SEQ ID NO: 122, 124, 126, 127, 130, 131, 133, 136, 139 and 147 showed no significant homologies to previously identified sequences. The sequences of SEQ ID NO: 120, 129, 135, 137, 140, 142, 144 and 145 showed some similarity to previously identified gene sequences, while the sequences of SEQ ID NO: 114, 118, 119, 121, 123, 125, 128, 132, 134, 138, 141, 143 and 147 showed some similarity to previously isolated ESTs.

In further studies, three additional cDNA libraries were generated from poly A+ RNA from a single small cell lung carcinoma sample subtracted against a pool of poly A+ RNA from nine normal tissues (lung, brain, kidney, liver, pancreas, skin, heart pituitary gland and spleen). For the first library (referred to as SCL2), the subtraction was carried out essentially as described above for the LAP1 library, with the exception that the tester and driver were digested with PvuII, StuI, MscI and DraI. The ratio of tester and driver cDNA used was as recommended by Clontech. For the second library (referred to as SCL3), subtraction was performed essentially as for SCL2 except that cDNA for highly redundant clones identified from the SCL2 library was included in the driver cDNA. Construction of the SCL4 library was performed essentially as described for the SCL3 library except that a higher ratio of driver to tester was employed.

Each library was characterized by DNA sequencing and database analyses. The determined cDNA sequence for 35 clones isolated from the SCL2 library are provided in SEQ ID NO: 245–279, with the determined cDNA sequences for 21 clones isolated from the SCL3 library and for 15 clones isolated from the SCL4 library being provided in SEQ ID NO: 280–300 and 301–315, respectively. The sequences of SEQ ID NO: 246, 254, 261, 262, 304, 309 and 311 showed no significant homologies to previously identified sequences. The sequence of SEQ ID NO: 245, 248, 255, 266, 270, 275, 280, 282, 283, 288–290, 292, 295, 301 and 303 showed some homology to previously isolated ESTs, while the sequences of SEQ ID NO: 247, 249–253, 256–260, 263–265, 267–269, 271–274, 276–279, 281, 284–287, 291, 293, 294, 296–300, 302, 305–308, 310 and 312–315 showed some homology to previously identified gene sequences.

D. Isolation of cDNA Sequences from a Neuroendocrine Library Using PCR-based cDNA Library Subtraction Using the modified PCR-based subtraction process, essentially as described above for the LAP1 subtracted library, a subtracted cDNA library (referred to as MLN1) was derived from a lung neuroendocrine carcinoma that had metastasized to the subcarinal lymph node, by subtraction with a panel of nine normal tissues, including normal lung, brain, kidney, liver, pancreas, skin, heart, lymph node and spleen.

Ninety-one individual clones were isolated and sequenced. The determined cDNA sequences for 58 of these clones are provided in SEQ ID NO: 147–222. The sequences of SEQ ID NO: 150, 151, 154, 157, 158, 159, 160, 163, 174, 175, 178, 186–190, 192, 193, 195–200, 208–210, 212–215 and 220 showed no significant homologies to previously identified sequences. The sequences of SEQ ID NO: 152, 155, 156, 161, 165, 166, 176, 179, 182, 184, 185, 191, 194, 221 and 222 showed some similarity to previously identified gene sequences, while the sequences of SEQ ID NO: 148, 149, 153, 164, 167–173, 177, 180, 181, 183, 201–207, 211 and 216–219 showed some similarity to previously isolated ESTs.

The determined cDNA sequences of an additional 442 clones isolated from the MLN1 library are provided in SEQ ID NO: 341–782.

E. Isolation of cDNA Sequences from a Squamous Cell Lung Carcinoma Library Using PCR-based cDNA Library Subtraction A subtracted cDNA library for squamous cell lung carcinoma (referred to as SQL1) was prepared, essentially using the modified PCR-based subtraction process described above, except the tester and driver double stranded cDNA were separately digested with four restriction enzymes (DraI, MscI, PvuII and StuI) cDNA from a pool of two squamous cell lung carcinomas was subtracted against cDNA from a pool of 10 normal tissues, including normal lung, brain, kidney, liver, pancreas, skin, heart, spleen, esophagus and trachea.

Seventy-four clones were isolated and sequenced. The determined cDNA sequences for 22 of these clones are provided in SEQ ID NO: 223–244. The sequence of SEQ ID NO: 241 showed no significant homologies to previously identified sequences. The sequences of SEQ ID NO: 223, 225, 232, 233, 235, 238, 239, 242 and 243 showed some similarity to previously identified gene sequences, while the sequences of SEQ ID NO: 224, 226–231, 234, 236, 237, 240, 241 and 244 showed some similarity to previously isolated ESTs.

EXAMPLE 2

Synthesis of Polypeptides

Polypeptides may be synthesized on a Perkin Elmer/Applied Biosystems Division 430A peptide synthesizer using FMOC chemistry with HPTU (O-Benzotriazole-N,N,N',N'-tetramethyluronium hexafluorophosphate) activation. A Gly-Cys-Gly sequence may be attached to the amino terminus of the peptide to provide a method of conjugation, binding to an immobilized surface, or labeling of the peptide. Cleavage of the peptides from the solid support may be carried out using the following cleavage mixture: trifluoroacetic acid:ethanedithiol:thioanisole:water:phenol (40:1:2:2:3). After cleaving for 2 hours, the peptides may be precipitated in cold methyl-t-butyl-ether. The peptide pellets may then be dissolved in water containing 0.1% trifluoroacetic acid (TFA) and lyophilized prior to purification by C18 reverse phase HPLC. A gradient of 0%–60% acetonitrile (containing 0.1% TFA) in water (containing 0.1% TFA) may be used to elute the peptides. Following lyophilization of the pure fractions, the peptides may be characterized using electrospray or other types of mass spectrometry and by amino acid analysis.

EXAMPLE 3

Preparation of Antibodies Against Lung Cancer Antigens

Polyclonal antibodies against the lung cancer antigen L773P (SEQ ID NO: 783) were prepared as follows.

Rabbits were immunized with recombinant protein expressed in and purified from *E. coli* as described above. For the initial immunization, 400 μg of antigen combined with muramyl dipeptide (MDP) was injected subcutaneously (S.C.). Animals were boosted S.C. 4 weeks later with 200 μg of antigen mixed with incomplete Freund's Adjuvant (IFA). Subsequent boosts of 100 μg of antigen mixed with IFA were injected S.C. as necessary to induce high antibody titer responses. Serum bleeds from immunized rabbits were tested for L773P-specific reactivity using ELISA assays with purified protein. Polyclonal antibodies against L773P were affinity purified from high titer polyclonal sera using purified protein attached to a solid support.

EXAMPLE 4

Protein Expression of Lung Tumor-specific Antigens

Full-length L773P (amino acids 2–364 of SEQ ID NO: 783), with a 6×His Tag, were subcloned into the pPDM expression vector and transformed into either BL21 CodonPlus or BL21 pLysS host cells using standard techniques. High levels of expression were observed in both cases. Similarly, the N-terminal portion of L773P (amino acids 2–71 of SEQ ID NO: 783, referred to as L773PA), with a 6×His tag were subcloned into the vector pPDM and transformed into BL21 CodonPlus host cells. Low levels of expression were observed by N-terminal sequencing. The sequence of the expressed constructs for L773P and L773PA are provided in SEQ ID NO: 784 and 785, respectively.

From the foregoing it will be appreciated that, although specific embodiments of the invention have been described herein for purposes of illustration, various modifications may be made without deviating from the spirit and scope of the invention. Accordingly, the invention is not limited except as by the appended claims.

SEQUENCE LISTING (789 sequences)

SEQ ID NO: 1 - DNA, 527 bp, Homo sapien
ccaccagtccacaaatgtgactggtaagggatctagtaacagaggatggagttgggcagaatattatcctggatgatatgcacccagcactagaatacacctttcattagaatgaagagaacagacaaagccctcagaaaagatacaaaggcagagacattgattagaacattatctcataacagaggtggggccattacccaccattattgtaaaataactgtaactaaccaaaacacatacaggcttctttaatggagttaataaaactatggcacattgggaatcaggggcagaggtactgttcccagacggaaaactgggataaagggagccatgctgacagggccttattccagtctaggttgttagaaaggagccctagcccagaaatgacagcaaatagccataatcattatgtggggctgaaccagaggaagccaggctgagccaagaagctggaagtatcttgaacggctctccaaatccaaagattatccatactctttatccctccagcgatgtgt

SEQ ID NO: 2 - DNA, 490 bp, Homo sapien
ccaagagttctccactgtgaagactgaaaggacctggtgacatttcggcatcagtcctgttaccacttggaggtaacagaagcaggctcgtgtcctcctttaattctaccacactacatgactcgcaattggttctgaaattagaacgttcaccatcgtacttaaaatcttaggggcatgaagagtcagctagaacaaggaaaaagaaagtcgcaggtagtaggtaagtaggtgggcacatgaaaagccaagctgctctgtccaacaccagtgtacatgtgctttaactaaatgaactccagaggccaacagcagcagacctgctcaattcaccttccaaatcagaacaagaccaaaaagctcaggcttgagttgtcaactatgcataggttccgccagtgctgaggggtgtgaggctctagttgtgaagaagctacaagaaatcatgatgcatgtgatctgggccgcactggcatttgcagctattcag

SEQ ID NO: 3 - DNA, 464 bp, Homo sapien
ggagctgtgggctcagtcgtggggcagattgcaaagctcaagggctgcaaagttgttggagcagtagggtctgatgaaaaggttgcctaccttcaaaagcttggatttgatgtcgtctttaactacaagacggtagagtctttggaagaaaccttgaagaaagcgtctcctgatggttatgattgttattttgataatgtaggtggagagttttcaaacactgttatcggccagatgaagaaatttggaaggattgccatatgtggagccatctctacatataacagaaccggcccacttcccccaggcccacccccagagattgttatctatcaggagcttcgcatggaagcttttgtcgtctaccgctggcaaggagatgcccgccaaaaagctctgaaggacttgctgaaatgggtcttagagtttaaatttcagcttccctactttgtaattgactgact

SEQ ID NO: 4 - DNA, 510 bp, Homo sapien
ccttatcacactgtaagtggtccaagcccatagggatgctctttttggttcctggaatttccagttggatgtgacagagatctttcagtataggtctaagtcaagagtagcctctgggttgaggtgggctgggagattaacatcttacctggggtccttcagataaacctgttggtttttcctgtctcatacaggcccatcttaagttttgatgttgaattaaaactacttctacccccttagttataaaaaaggccacaaggagcatttatgtggatatctggaagtgagatagttattccattcccaggaaaagaaaaataaagctaagttacaaaactaaatctatatgcaataaagttattatatactgctttgtttaagcagagtcctctggaatttatgtacagtacattagttttcagctatttatattccacaagttagaccttaagattctctggttttaagacaattgttaaagatacttctaaagctctgagcagttca

SEQ ID NO: 5 - DNA, 452 bp, Homo sapien
acagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggtaaatcatctcctttatttggtgcctcatgtgagtactggttccaagtgacatgacccagcgattatgtttacagtctggacttctgatcaagagcgttcttgaaattttccttcagttttaagacattttcatgcaggcagagtgttcttcccctaaaggcacttgacactcatttttt

SEQ ID NO: 6 - DNA, 336 bp, Homo sapien
tatagagtgctgacatctgacattgagaaattcatgcctattgtttatactcccactgtgggtctggcttgccaacaatatagtttggtgtttcggaagccaagaggtctctttattactatccacgatcgagggcatattgcttcagttctcaatgcatggccagaagatgtcatcaaggccattgtggtgactgatggagagcgtattcttggcttgggagaccttggctgtaatggaatgggcatccctgtgggtaaattggctctatatacagcttgcggagggatgaatcctcaagaatgtctgcctgtcattctggatgtgggaaccgaa

SEQ ID NO: 7 - DNA, 376 bp, Homo sapien
ctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttattttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctg

SEQ ID NO: 8 - DNA, 406 bp, Homo sapien
ggtagggagcaattctattatttggcattgcatggctgggttgaattaaaacagggagtgagaacaggtgagtctagaagtccaactctgaaaaggaccactgtacatttgaacacacggctgtgttaaagatgctgctaatgtcagtcactgggtgcactaaaggatctcttattttatgtaaaacgttgggattgacaagatagatctgatactctgttaagttaccctctgaagctacttcttgtgaaatactaatgacagcatcatcctgccaagcgaaagaggcaggcataagcaaggacaaattaaaagggggtaagagccttatcatgatgaggagtcttgttttgacatcttgggaaaagctgtccatagtgtgaagtcgtcaatttctcaccatggt

SEQ ID NO: 9 - DNA, 330 bp, Homo sapien
actactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctgg

SEQ ID NO: 10 - DNA, 449 bp, Homo sapien
ctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgcgggtaagttgaggttatcttgggataaagggtcttctagggcacaaaactcactctaggtttatattgtatgtagcttatattttttactaaggtgtcaccttataagcatctataaattgagttctttttcttagttgtatgg

SEQ ID NO: 11 - DNA, 472 bp, Homo sapien
cctcgatgcatgctgctctacctctcatcagcccacagtctgacacgaggtcatctttggtctgtggtgaggtatggatgtctgcagtctacacaacagccctgcagaacgggcctggacaacccttgggggataagacagccacacatggctcaggctgttaggtgtccactgtcacagtccaaagagaaaggtacggcctccaagggggcagcttaagccaacatgtaagacttgggcacgatgaaaggacgggggtccagctacgaatgtttttgttcttgatgtcaagttgccagctactggaaggcaggagcagtttcttctttttcccactctgtgctgggtacttgggagaggcgaaataaataccagactgtccactcctcagcctaaggtccttctcaagtcctgcacactcagcacttgctctttaacgtggcatatgttcccccatcttcccctggtaatg

SEQ ID NO: 12 - DNA, 371 bp, Homo sapien
ttttttttttttttttttttttttggaratttgkcacattttattcagwatttctgctgcactgccagcctagggatgcacttgattcccaagaaatgcaactgtcctattcgcaragccgtccacaggtacctaccccctggactgcagcaactttattaccttaactagcacaraacagaggttgatttaaactccttacactcacttctcaratcaatgaatgggcaaaraaacmcctcatggctctgggaaggcatgctgaracccgtttttgcaagtcctgaggaatggaaraatatagctgccaggtatcccaagtctagggcagggagggkagtatcggcatcactttcactgcattctgttgg

SEQ ID NO: 13 - DNA, 493 bp, Homo sapien
  misc_feature (1)...(493): n = A,T,C or G
ccagtccaacctgctcctcattattgtataaatgagcagaatcaatatggcggaagccagctycaattgccaatttggtggcctctaaagctttacttttaggaacctctgcaggcgcataggtgccaaatcccaggacaggcatgaagtgaccatcattcagcttcacacactgatatttcgaatccatttctgtcnnnnnnnnnnnnnnnnnnnnnnnnnnnnnnnnnnnnnnnnnnccaacctgctcctcattattgtaaacatgtgcagaatcaatatggcggaacccagcttctattgctaattttgtgacctccaaagctttacttctcggaaccttggttcttccgagcgctcagcaatcccgccgagcttctttgagacgtcctcaggtgtcctttgacgatgcgtcctccactttcacacactctagcattccttcactggggtcttcattgccccacattgggcagccaggaatgttggggtg

SEQ ID NO: 14 - DNA, 540 bp, Homo sapien
ccagatggtccataatatgtcaccgagcaggtgaatggcatttgtatgtcagccttggttgtcttgtactccagggtggaagtcatggtatagagctgagtcactgggtccatttcctttttaaaattatgaccaccgctccttcaaggggatgtagcacttttccattcctgtaccatgtgatattgccatctggataactgtcttctgaaatgcagtcacccaacttttttagctgctctgtttcgagaaacagtgctttgcttacaatttcaggtttagatggttgcttgaacaccttgactattgtaggtgcctcaaacacgttgtcctcagttactagcatgcacacaaatctcttttcatcactgatccttgcattactgatagacaaagtgtagttttctgagaggttcaatctgtctttgtattctggtacatcgtcgtactgcacacttttctttgtagaggatctgaaggcaataaatactggggagccatcgggcttttcatatttccatttgcccaaacatgagattc

SEQ ID NO: 15 - DNA, 421 bp, Homo sapien
tacccacctccagcctcccatgtgagcctgtccttatgtatagtgtccaacctctgattctagcagtcaagtgtcttccccaatcctaatgtcccctgatatgtctctagcgacttgaccatctcttgttccttgggactggggccagcctcttgtctgcccacttccctctcattagtcagatagccccaaaggctctatctttagctcccagagaactttttggtcctcagtatttcccttcccctttccttcctattccccacaactgggggagggaagggagaacaggggcacctgatcatcaatctcccctgcccctctcttgaagccccctagatttggatgaagagcaggccagtgagcagggcaaagcctgctaggagcagaatgaccttgaggatcctttgctcagaactgg

SEQ ID NO: 16 - DNA, 236 bp, Homo sapien
gccgtgtgtgcttttcccagtgccgaggtacctatcgctcacggccaggagcttgtcgtggctgacagcaaagagctgctctctgtgggcctgcttcatctcatccgagaggccgtacaagaagtggtccattcctttgtctgaaggagcgacaggagcatctacggttgagaagacagaaagtttggcttcgtcgatgtcttgctgtgtgaattttccagacttagcccagtcga

SEQ ID NO: 17 - DNA, 424 bp, Homo sapien
ccagaaaggtgacagtggttttccagggcctcctgggcctccaggtccacctggtgaagtcattcagcctttaccaatcttgtcctccaaaaaaacgagaagacatactgaaggcatgcaagcagatgcagatgataatattcttgattactcggatggaatggaagaaatatttggttccctcaattccctgaaacaagacatcgagcatatgaaatttccaatgggtactcagaccaatccagcccgaacttgtaaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatgg

SEQ ID NO: 18 - DNA, 154 bp, Homo sapien
gtcaccaactccttcagcgcctccacagggstttcggacatgacagcaaccttttctcccaggacaattgaaatttgctaaagggaaaggggaaagaaagggaaaagggagaaaaagaaacacaagagacttaaaggacaggaggaggagatgg

SEQ ID NO: 19 - DNA, 445 bp, Homo sapien
caacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaaagtgtgactatgaaaatgttccaaccactgtatttactcctttggaatatgg

SEQ ID NO: 20 - DNA, 211 bp, Homo sapien
gggtgccactgcctgcttgaaagcactttctgaacctacagaagttgggtattgtctgaaatcccagaggacccataagtgccggtgacaagctgtctgtcaggggagaggctccagaacctgggttcgtccccagtgagaccggaggatgatcccccaaggactgcgcagcatcagctcttggtgggcctctgccttctcttctgtttgg

SEQ ID NO: 21 - DNA, 396 bp, Homo sapien
tgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattgg

SEQ ID NO: 22 - DNA, 277 bp, Homo sapien
ggaaccatgtggccggcgcccttgatcgtgagaaaggcgatgtgggagaactccttcacgaagccggcaatctgctccccgctgtccccgtacttcactaaccagggccggcgctgcacctccatcttctggttgagggaatccacaaaccactcatcccccatgaaattgcaggccatgtctacatctccattatataataggatctgggatttctgtgagctaagcagcttcagatactgggagttcatgcttcggtagagacggcggtactgta

SEQ ID NO: 23 - DNA, 634 bp, Homo sapien
tctgaccatccatatccaatgttctcatttaaacattacccagcatcattgtttataatcagaaactctggtccttctgtctggtggcacttagagtcttttgtgccataatgcagcagtatggagggaggattttatggagaaatggggatagtcttcatgaccacaaataaataaaggaaaactaagctgcattgtgggttttgaaaaggttattatacttcttaacaattctttttttcagggacttttctagctgtatgactgttacttgaccttctttgaaaagcattcccaaaatgctctattttagatagattaacattaaccaacataattttttttagatcgagtcagcataaatttctaagtcagcctctagtcgtggttcatctctttcacctgcattttatttggtgtttgtctgaagaaaggaaagaggaaagcaaatacgaattgtactatttgtaccaaatctttgggattcattggcaaataatttcagtgtggtgtattattaaatagaaaaaaaaaattttgtttcctaggttgaaggtctaattgatacgtttgacttatgatgaccatttatgcactttcaaatgaatttgctttcaaaataaatgaagagcag

SEQ ID NO: 24 - DNA, 512 bp, Homo sapien
gcaaaacaagcctaagcaagcacaacgaagagcagaagtcagtgaaattaaaaagaggaaaaagaaaaatcataaaaatcataaaaagttatttctttgaaaagatcaatgaaatttagcaagactgacacagataaaaaggaattagacccaaatcagtgaacaggaatgaaatagaggatatcactacagaggctgcagccattgaaaggataattaggaaatcccacagataactttgtgctcataaatttgacaatgtagaggaaatatctttagttttaattagctttttattttagtttttctcaaaaactaaaacttaataaaactcaaccaagacaaaatagacaatcagaatgtaggcatacctcagagatgtggcggatttggtttcagactactgcaataaaccaaatatggcaataaaaggagtcacagaaagtggtttcccagtgtatatatataaaagttacatttactctatgaagtgcaataacattttgtctaaa

SEQ ID NO: 25 - DNA, 461 bp, Homo sapien
ctctgtttcagcacctcattgggattattgaactcattaaattctttacatgaacttgaattgttcattgaaatctctagccatttccctggttaaacaggataatctttttttttcactaaagaacattcgtggtggtttagtgatgaggttaatattcccctcttgtccacctccacattggaaaaaccacgttggactgagttttgaggagcaaagaactaatcacttgaccaaaggggccctgtatccccacaagccctgggtatttttctctcatagagagaagagggtctgtatggatacctgaaaatgtgattttatatattcttggcatccaggggagaaaaatcaaaaagcaaggaagttacagttatctccccagaaattaatgggtcatgtcaagactataggttttcatttccttctgttgcttgttagaatgatgttcttgtgggaaa

SEQ ID NO: 26 - DNA, 317 bp, Homo sapien
tgctggagtcggaactgctgcctttgtttggcggccttgtttcttaaatcagttccctcttaggatttattacactaaaaaaaaattagtttttgaaaagaaataggagaatacagaaacatgaatttcacgaggctatcatctaacagtgggggctttctacacacgtggtgccaaaatgtgtcattctgagtcaattgcaattcctctctaggagtgaaaagagataaaagataagccaagaaccctggacagattcttggtgttggtgacaaagaggaaaggacctgagaatggggctggtggggagagggggg

SEQ ID NO: 27 - DNA, 250 bp, Homo sapien
taattgctgtgattattagaattctatcatgactgtattgtagtttttgctctattycagataagcmagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaa

SEQ ID NO: 28 - DNA, 532 bp, Homo sapien
cctatatcattcatttatacagaagctgcttgctgcttagcaagttggtgggtttgattttccttggttgctttgcagacctcccttgagaggattccttctggatggagatttctttgttgctgtctcccttgccacaactctgaccaagattgcattgcgctatgtagctttggttcaggagaagaaaaagcaaaattcttttgttgctgaggctatgttgctcatggctactatcctgcatttgggaaaatcctctcttcctaagaagccaattactgatgatgatgtggatcgaatttccctgtgcctcaaggtcttgtctgaatgttcacctttaatgaatgacattttcaataaggaatgcagacagtccctttctcacatgttatctgctaaactagaagaagagaaattatcccaaaagaaagaatctgaaaagaggaatgtgacagtacagcctgatgaccccatttccttcatgcaactaactgctaagaatgaaatgaactgcaaggaagatcagtttcag

SEQ ID NO: 29 - DNA, 486 bp, Homo sapien
ctgtttttggacttaattaacywttgcaagtggaaaccaagaaataattgtagcataactctctctattgtcatgttgcttctttctgcaaatatatcttacaagttagactttaaacctttgatctcccacaccaaaagagaaaataatatttatatggaagtaattttattttagtgtttgtgatttattgtggagagcaggbgtttaaaaattttagaatttctttttaacaaaatcaaatacattgttaaggtaacaaagaataattcactatttcagcatttcaaagcaacatattctacaacttcaaagatatttgcaaaaataatacaactgttgaagttcaaatgttatggaaagaaacattagaagtatgaaaagtggtacaaaaacatgtttctttttattctcttggatatatatctatatatttaggaaaatacatatatgtatgtgtatgtatatatatgtatgaaaatatac

SEQ ID NO: 30 - DNA, 240 bp, Homo sapien
aagacctgaggaaggaaaacaaattggcttcctgctgaagaakcaaaatagacattttttaatgtctcttgaccccagttccaagttcaccctgttgcctgttcttcctcccaccttttggggttctataactgcatcccccacacatctttcaccaccaccccatacataccagctctcctgttgtgggattcaggacataggaagagttgctgaaggcacgggtgcttttgggattcg

SEQ ID NO: 31 - DNA, 233 bp, Homo sapien
ccattgatgcaggatatcggcacattgactgtgcctatgtctatcagaatgaacatgaagtgggggaagccatccaagagaagatccaagagaaggctgtgaagcgggaggacctgttcatcgtcagcaagttgtggcccactttctttgagagaccccttgtgaggaaagcctttgagaagaccctcaaggacctgaagctgagctatctggacgtctatcttattcactgg

SEQ ID NO: 32 - DNA, 233 bp, Homo sapien
gaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctagg

SEQ ID NO: 33 - DNA, 319 bp, Homo sapien
ctgggcctggatggtctaggatagccttactcacttgcctggcaggtgacaggctgttggctggaattgcttggttctcctccatgtggcctctccagtaggctagctcaggcttattcacatgatggcttcaggattccaaagagagtgagagtagaagctgaaagacttcttgagttcttggcctggaactgggactaggacagtgtcacttctgctaagttcttttggtcagagcaaatcacaaggctttacccagattcaagggatgagaaacagactacatgtcttgatgaggggaaccacaaagagcttgtgg

SEQ ID NO: 34 - DNA, 340 bp, Homo sapien
tacagatttaattcatgttattaactccctgccttttacctcctccctcctcccttggcacaactgccagatggatgtggctggaagtcagaggacattctcgtgggttcgtgggcctagggtacaaatgacctcagcgtgacagcaaacaggacagagaagaccaggctcttactcaggaatccaccagccaggagaatgacaatgttgaacaccggaaccctgatgatatctgtcacatttgtaaggttgatttcagagtcaggagtggagacatcggcagttgacttgggtggagcttgggtcacagttctggggctggtatagagtgggcacaagg

SEQ ID NO: 35 - DNA, 170 bp, Homo sapien
acatgggtccttcactcctcgctgagatgttgcggcagccttttcttccaatgcggttgtggcaggagaatccacggatgtaatgttttcacctttttccctgagggtgctttctgaggaaccagyccttaagaggtggggtcttggattcctgacccaggcgtccggca

SEQ ID NO: 36 - DNA, 475 bp, Homo sapien
ctgtttttggacttaattaaccattgcaagtggaaaccaagaaataattgtagcataactctctctattgkcatgttgcttctttctgcaaatatatcttagaagttagactttaaacctttgatctcccacaccaaaagagaaaataatatttatatggaagtaattttattttagtgtttgtgatttattgtggagagcaggtgtttaaaaattttagaatttctttaacaaaattctaaagagaaaataaaaaagaaatcacagtatttacagagataacagaatggcttagccatgcaaaacaaataactttggtttttccccttttactttggtttaaatgttgaccaagattcaattttttttcctgccaaataaaacttcaataaaagtttagaggcaaaataacgtattttctttttttcccataatattttatacagcatcgagtctaagaatattttatgcattt

SEQ ID NO: 37 - DNA, 246 bp, Homo sapien
ccttgagcttgggccgggcactgaggcgccccacatatgctgagagcagggggaacgcatccaggcagccaggggctaggacctcatggatcagcagcaagtccagcaggttgtagtcagcgaaggagatctggtctcccacaatgaaggtcttgcctccctggttctgggacagcagggtctcaaaaggcttcagttgcccgggcagtgccttcacatagtcatccttgcccacctcatagttgg

SEQ ID NO: 38 - DNA, 512 bp, Homo sapien
gctggaagtgaaatgcagatcagacccattgtgatgtcacagaaagatggggacaggccaaagaaaaaagtgactttcaactcttcttccatcatttttatcatcaccagtgatgaatcactgtcagttgacgacagcgacaaaaccaatgggtccaaagttgatgtaatccaagttcgtcctttgtaggaatgaagaatggcaacgaaagatggggccttaaattggatgccacttttggactttcatcataagaagtgtctggaatacccgttctatgtaatatcaacagaaccttgtggtccagcaggaaatccgaattgcccatatgctcttgggcctcaggaagaggttgaacaaaaacaaattcttttaattcaacgggtgctttacataatgaaaaaaccacttgtggcacacgatgggcatctaacatcatcatcttctaatgtgttggagattttcatttcaaatatattttttaaattactctattttccaaaacacgtaat

SEQ ID NO: 39 - DNA, 370 bp, Homo sapien
ttttatgaacaagatataaggatcaaaaaaaagggtgttgatatgtttttccaagcagagatgtactcgactctgtcctatttagccttcccatacctgacttctaatcacttttcctggtgccctyccatctccctaaccccccctcacagggatgcctcctcccaaggctccagaaactctgaccctcgcactgctggagggagcccatgaattgctggtcaatatcgctcatcctctakactccatcctgcgtgtgcttcttcctacaagagctagagaggcactgactgataaatacctgtcacctgcccctttcccagagggtgaaactccacccactcccactgcagaaatgaatcttaaatgg

SEQ ID NO: 40 - DNA, 204 bp, Homo sapien
cctgagggttttccctttaaattttcattgagttgtccatctccagcatatagggcttcaggagcagagcagaccttgtttttagtggttccatgggataaaatgggattggaggagctagaagaattcagggtctggtccaatctgccagtcttcctgaaatatcgaaaatacaccagggctgctatatcagagccaccctgg

SEQ ID NO: 41 - DNA, 447 bp, Homo sapien
caggcagcaattcgtaaagaattaaatgagtacaaaagtaatgaaatggaggtacatgcatcaagcaagcacttgacaagattccacaggccatagagattttcttctgagaagaatttgtgtttaattttttgataccaacactgaacattcatcagggaactttcctgaagttcagctcaagactaccctacctgctgtgtttgtgagaagagtaggatcacacacacaggtgcaatcttgaccacacttacctgcaagaggagtaaccagaggacacacttccttccttctttggtgtctgaggagtgtgaactgttggggtcagttaagacccaacataactctatcagaagaaaactgttgtttgcctttcaaccttgttttacagttctgcagtgtagtggaggacgggcaacgtgcatgtgcaggctcaccactcccagg

SEQ ID NO: 42 - DNA, 498 bp, Homo sapien
ctggttttgtaaaaacagtctctttattctactgtgctgaaaccctcaccaatatagaaaattagattctcattgcactgaactatatttatatgcctaagtatgtagaagtaaaattatataccccaaaaggattttatcttgttgtatatattaaatgttatttctgcatatagggtcttttatggagaaactgatgatgataagcttaatactcacttgtttagcagcatctgaatgcacaaatgctttatatatctcttctgctttacagggcaaaagatcagactctgttttcttatagtcttcacaagccagccagaactcaatattctcctcactgaattcagactttaggaaacttccaaagacattttgaccagtttggttggcaagaagtttttccagagattgagaccattgcattacttcagcagcagaaagtacatccttggacttggaagatttcattccagattccagatgtgggatcataga

SEQ ID NO: 43 - DNA, 312 bp, Homo sapien
caggaaggcggccaagaatgtgagtgcaaagattggttcctgagagccccgagaagaaaattcatgacagtgtctgggctgccaaagaagcagtgcccctgtgatcatttcaagggcaatgtgaagaaaacaagacaccaaaggcaccacagaaagccaaacaagcattccagagcctgccagcaatttctcaaacaatgtcagctaagaagctttgctctgcctttgtaggagctctgagcgcccactcttccaattaaacattctcagccaagaagacagtgagcacacctaccagacactcttcttctc

SEQ ID NO: 44 - DNA, 417 bp, Homo sapien
ctaacacatttactctccactattcgtactctggtagccatgttaaccccatcagagattccttctcaagccatgtctcagagctgagaggcatcccagcaagttttgcagctcacagttttttccgtaaattacttattctataaaattggagtaggccataaactttggagggccctagaccaattttttggattatttttcgtcttctatcattccgctgatcttagatattctctgcattaaatattaaatatcacttctaggctgaaaaatccccctaaaaatatttctagctcagatttttcctccaaattctgcaatagaagatcacaatgtgaactctgcatctccatgttaaagtctaatggacattcacacttagcatgtctcaaagaaatctcatgtaaaccatgg

SEQ ID NO: 45 - DNA, 494 bp, Homo sapien
cgcgtgtctgtggtatgtgtacacgtgcatgttctgcatgtctgtaggtcacacatgctttggtgcatgtacacgtgtgtgtgtgtatgcgtgtaggagctcacacttgtgtacacgtttgtgtgcatgcatgtgtgcaggagcttgcacgtttgtggtgggtacatgtacatatgtgagtgatcctgtgtgcaagcccccatgtggacatggctatgagtgagcgtggagccaaaagccaggtaacacgcatgcagcaggcccactgtgcgtgtctgagacggtctgtggcagggactgggtgtgaatcatgcagcaggcccactgtgcgtgtctgagacggtctgtggcagggactgggtgtgaatcagtgaccgtgtctctgaccaacatgctgaattacaaattgataatttattaacctgtgcagcaacaaataagatttttcaaaactcaacaaagtgctcaaagttgacattacttgcttcaaagtt

SEQ ID NO: 46 - DNA, 516 bp, Homo sapien
ccagtccaacctgctcctcattattgtataaatgagcagaatctatatggcggaacccagcttctattgctaattttgtgacctccaaagctttacttctcggaacctcctcctttggccgtcatttgatcattcaactctttgtcagtggcaactcccgctattttggtgtgttggtttgttactacacagtgagcacaaacatggtggtccaatacagaggctcttcctgtcaggtgtcaaccagaaagttcatctaacactgtgatatttgcatccttcttgaacagttgttggctgaagattcatttgatgaatcgatttttcaaaagagatgattcttggttcttccgagcgctcagctctcccgccgagcttctttgagacgtcctcaggtgtcctttgacgatgcgtcctccactttcacacactctagcattccttcactggggtcttcattgccccacattgggcagccaggaatgttggggtgatcagacacaacaccaggtcatg

SEQ ID NO: 47 - DNA, 459 bp, Homo sapien
ccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgaksaaaaaaaaaaaa

SEQ ID NO: 48 - DNA, 430 bp, Homo sapien
cctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtgg

SEQ ID NO: 49 - DNA, 288 bp, Homo sapien
ccatccgaagcaagattkcagatggcagtgtgaagagagaagacatattctacacttcaaagctttggwgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacgtgggaggccrtggagaagtgtaaagatgcaggattgg

SEQ ID NO: 50 - DNA, 411 bp, Homo sapien
ccagagaatgacattcatgtccccgtggatcccttgcagagagtacatggagccactgccaccagtggtgatggaaagcactgtcttcttactccggaagggtcctttgtcatacatggcagcgtaagtgtaagcaaactctcctatgaacactcgctcaaaccagcctttcagaatggcagggactccaaaccactgcagggggaactggaatatcacaaggtctgcggcttccagcttcttttgttcagccacaatatctgggctcagatggccttctttataagccagaacagactcggcaggatactgaaagttcgcagggtccttcagtttacctgtgatgtcctttctggaaatgatgggattgaagttcatggcatagaggtccgactccaccacctcccatcc

SEQ ID NO: 51 - DNA, 503 bp, Homo sapien
gatatcttatgattaaaaacaaattaaattttaaaacacctgaagatatattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattaaga

SEQ ID NO: 52 - DNA, 503 bp, Homo sapien; identical to SEQ ID NO: 51

SEQ ID NO: 53 - DNA, 531 bp, Homo sapien
tttttttttttttttaaaatgaggatattttattatttcaggtaattttcccagaggkgagaatagtacatgggaaattctctttaggccaggtctagtattacagkgtggkgctcaaggccgcccatcagaacagtgatactctcccaacagatttcatccaccccgtctccactaacttttgccataaaaattcctctgaattgtatcttcttggaagaagtaaatatctgttcgactatacaaagaaacagagaaaccactcccattgcaatcaatcttcaagagagggagcaggcaagccgtgttctttctgctgagttttatagactctgacaagctgtgaaataaacataaacagaagacaaaacagtgccacaaataagcagtagatgaccctgtgacaagacggcattgcagaacaaagactgacgtttaaaggggagtcatgcagagtaacatgggaacacaagcctgacaacctggtcagcttccacttactctagctcctttgaactctcaacactaaaa

SEQ ID NO: 54 - DNA, 450 bp, Homo sapien
ccatgggtgtctggagcwccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcag

SEQ ID NO: 55 - DNA, 648 bp, Homo sapien
caacttcaaccacaggctgctggasatgatcctcarcaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctrcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggygayttcagcaagctacagcaaagcccattggccggaaaaaatatcaagggtcaaat

SEQ ID NO: 56 - DNA, 536 bp, Homo sapien
ctggcatgagaatatttttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttaaaactcttctctattataacagtcaatttctgactcacagcagtgaacaaacccccactccattgtatttggagactggcctccctataaatgtggtagcttcttttattactcagtggacctgcccgggcggccgctcgaagccgaattccagcacactggcggccgttactagtggatccgagctcggtaccaagcttggccgtaatcatggtcatagctgtttcctgtgtgaaattgttatccgctcacaattccacacaacatacgagccggaagcataaagtgtaaagcctggggtgcctaatgagt

SEQ ID NO: 57 - DNA, 391 bp, Homo sapien
aggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttatttgtctagttggatttcatttcttctggaaaatttattgtttattggcatgtgacccttgactgatggcttcattagcattytgtttttctttttggatccttaatagaaaactcaat

SEQ ID NO: 58 - DNA, 455 bp, Homo sapien
gaagacatgcttacttccccttcaccttccttcatgatgtgggaagagtgctgcaacccagccctagccaacgccgcatgagagggagtgtgccgagggcttctgagaaggtttctctcacatctagaaagaagcgcttaagatgtggcagcccctcttcttcaagtggctcttgtcctgttgccctgggagttctcaaattgctgcagcagcctccacccagcctgaggatgacatcaatacacagaggaagaagagtcaggaaaagatgagagaagttacagactctcctgggcgaccccgagagcttaccattcctcagacttcttcacatggtgctaacagatttgttcctaaaagtaaagctctagaggccgtcaaattggcaatagaagccgggttccaccatattgattctgcacatgtttacaataatgaggagcaggttggactgg

SEQ ID NO: 59 - DNA, 398 bp, Homo sapien
  misc_feature (1)...(398): n = A,T,C or G
ctcagaggcagcgtgcgggtgtgctctttgtgaaattccaccatggcgtaccgtggccagggtcagaaagtgcagaaggttatggtgcagcccatcaacctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactngntcggatcatgctaaaaggagataatattactctgctacaaagtgtctccaactagaaatgatcaatgaagtgagaaattgttgagaaggatacagtttgtttttagatgtcctttgtccaatgtgaacattt

SEQ ID NO: 60 - DNA, 532 bp, Homo sapien
gacttctgagacctggggcacccgggcctttgcggcagctactggcagggcctggccacctcataggactcagttcccttctgaacactcgggggacatgggcctctaactgcccactctgatatgcctgggtgagcctaggagggaaggctctgatttggatttctccagtcaaagctcacagaaaaaaacctggcactttgattttcatgggatggtcctaacagggtcagtcacctccgagcagtttgggaacccagtttcttgtcctgggccctcaggtcagcctggctgaattaggacccttccttggcacaggggtgagaaagagcttggggaacgcttggcattatggagggctggaaggggctcaaccccgatttggagagaagtttgggatggagtgggcgagagattgagagagcgagcaggaaaagaggtcttggagcctgggactgatggtggataaggcctggaaagaasatgacsaggaggaggagagagggaagtgggtggatgaggagcaggctga

SEQ ID NO: 61 - DNA, 466 bp, Homo sapien
gcgacggcgacgtctcttttgactaaaagacagtgtccagtgctccagcctaggagtctacggggaccgcctcccgcgccgccaccatgcccaacttctctggcaactggaaaatcatccgatcggaaaacttcgaggaattgctcaaagtgctgggggtgaatgtgatgctgaggaagattgctgtggctgcagcgtccaagccagcagtggagatcaaacaggagggagacactttctacatcaaaacctccaccaccgtgcgcaccacagagattaacttcaaggttggggaggagtttgaggagcagactgtggatgggaggccctgtaagagcctggtgaaatgggagagtgagaataaaatggtctgtgagcagaagctcctgaagggagagggccccaagacctcgtggaccagagaactgaccaacgatggggaactgatcctgaccatgacggcgga

SEQ ID NO: 62 - DNA, 548 bp, Homo sapien
ttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttc

SEQ ID NO: 63 - DNA, 547 bp, Homo sapien
tttccaaagcggagacttccgacttccttacaggatgaggctgggcattgcctgggacagcctatgtaaggccatgtgccccttgccctaacaactcactgcagtgctcttcatagacacatcttgcagcatttttcttaaggctatgcttcagtttttctttgtaagccatcacaagccatagtggtaggtttgccctttggtacagaaggtgagttaaagctggtggaaaaggcttattgcattgcattcagagtaacctgtgtgcatactctagaagagtagggaaaataatgcttgttacaattcgacctaatatgtgcattgtaaaataaatgccatatttcaaacaaaacacgtaatttttttacagtatgttttattaccttttgatatctgttgttgcaatgttagtgatgttttaaaatgtgatcgaaaatataatgcttctaagaaggaacagtagtggaatgaatgtctaaaagatctttatgtgtttatggtctgcagaaggatttttgtgatgaaaggggattttttgaaaaat

SEQ ID NO: 64 - DNA, 528 bp, Homo sapien
  misc_feature (1)...(528): n = A,T,C or G
cacctmctcccsccwggcgcttwctcsgacgccttgcccascgggccgcccgaccccctgsrccatggaccccgctcgcccsctggggmtgtygatkctgctgcttttcctgrckgaggctgcactgggcgatgctgatcargagccaacaggaaataacrcggagatctgkctcctgcccctagactackgaccctgcckggccctacttytccgytactactacgacaggyacacgcagagctgccgccwgttcctgkrckggggctgcrasggcaacrccaacwattyctacacckgkgaggmttrcgackatgctwgstggargatagaaaaagttcccaaastttgccggctgmaagtgaatgaggacnaccagggtgaggggtacacagataagtatttctttaatctaakkwccatgacatgwgaaaaattctttnncggtgggngtcaccggaccggattgagaacangtttgcagatgangctactgggatgggctcctgcrcacnaaagaaantatca

SEQ ID NO: 65 - DNA, 547 bp, Homo sapien
  misc_feature (1)...(547): n = A,T,C or G
kgaatgaasaacgaacgctggaagtagaaatagagcctggggtgagagacggcatggagtacccctttattggagaaggtgagcctcacgtggatggggagcctggagatttacggttccgaatcaaagttgtcaagcacccaatatttgaaaggagaggagatgatttgtacacaaatgtgacagtctcattagttgagtcactggttggctttgagatggatattactcacttggatggtcacaaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaangtatcaaacagctactgaaacaagggtcagtgcagaaggtatacaatggactgcaaggatattgagagtgaataaaattggactttgtttaaaataaagtgaataagcgatatttattatctgcaaggttttttttgtg

SEQ ID NO: 66 - DNA, 535 bp, Homo sapien
ggggaggtctacgcttctagagcttgagccagcggggcgaccctgcagtggcaggactcggcaccgcgccctccaccgccggttggtggcctgcgtgacagtttcctcccgtcgacatcgaaaggaagccggacgtgggcgggcagagagcttcatcgcagtaggaatggcagccccatctatgaaggaaagacaggtctgctggggggcccgggatgagtactggaagtgtttagatgagaacttagaggatgcttctcaatgcaagaagttaagaagctctttcgaatcaagttgtccccaacagtggataaaatattttgataaaagaagagactacttaaaattcaaagaaaaatttgaagcaggacaatttgagccttcagaaacaactgcaaaatcctaggctgttcataaagattgaaagtattctttctggacattgaaaaagctccactgactatggaacagtaatagtttgaatcatagtgaacatcaatacttgttccctatatacgacacttgataattaaga

SEQ ID NO: 67 - DNA, 527 bp, Homo sapien
atttctgccacttaattcaaacagtcatatgcaggtcgcttaatttatttgtgcttttgtttcatcttctacaaggccctcttagctctaaaacttgacagtggaataaggaaatgtttttccaaatctgcattgccggtgagatcctcaacatcagcatgttgagatggacctcaaccccacctctaaccctgaaacacactactcgatattatcttaggtatgttttagggtttagtttgtaaaataataatttatttttgaaggaaatataaaatattaaagagtaataatagctatcattttttaagattcaatctaaaacaatggactctttttttttccatttgtgatgtagataagcaagacaattttgatcatgagtggtgaaaagaggatcaaacttgactattcttgcaatggcagtccagcaacaagcctttcatttacattaaattataacttttcattcattcctaaaccaaacttaaaattctgctttcctttgagtagaaggtatttaactt

SEQ ID NO: 68 - DNA, 431 bp, Homo sapien
gggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgwtcctttagtgcaatacaataaaactctgaaattaaaact

SEQ ID NO: 69 - DNA, 399 bp, Homo sapien
gacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaraaaaaaaaa

SEQ ID NO: 70 - DNA, 479 bp, Homo sapien
cgcggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccaggtgctgggaagggaaatgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattaggatatttgacttaaactatctcaataaagttttgcagctttcaccaaaaaaaaaaaa

SEQ ID NO: 71 - DNA, 437 bp, Homo sapien
ctcagcggctgccaacagatcatgagccatcagctcctctggggccagctataggacaacagaactctcaccaaaggaccagacacagtgrgcaccatgggacagtgtcggtcagccaacgcagaggatgctcaggaattcagtgatgtggagagggccattgagaccctcatcaagaactttcaccagtactccgtggagggtgggaaggagacgctgaccccttctgagctacgggacctggtcacccagcagctgccccatctcatgccgagcaactgtggcctggaagagaaaattgccaacctgggcagctgcaatgactctaaactggagttcaggagtttctgggagctgattggagaagcggccaagagtgtgaagctggagaggcctgtccgggggcactgagaactccctctggaattcttgggggg

SEQ ID NO: 72 - DNA, 561 bp, Homo sapien
ggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgac

SEQ ID NO: 73 - DNA, 916 bp, Homo sapien
ggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccattaaaaaaa

SEQ ID NO: 74 - DNA, 547 bp, Homo sapien
agtggcattaacttttagaatttgggctggtgagattaattttttttaatatcccagctagagatatggcctttaactgacctaaagaggtgtgttgtgatttaattttttcccgttcctttttcttcagtaaacccaacaatagtctaaccttaaaaattgagttgatgtccttataggtcactacccctaaataaacctgaagcaggtgttttctcttggacatactaaaaaatacctaaaaggaagcttagatgggctgtgacacaaaaaattcaattactgtcatctaatgccagctgttaaaagtgtggccactgagcatttgattttataggaaaaaatagtatttttgagaataacatagctgtgctattgcacatctgttggaggacatcccagatttgcttatactcagtgcctgtgatattgagtttaaggatttgaggcaggggtaattattaaacatattgcttctattcttggaaaaatagaagkgtaaaatgttaataatacaaatgtcactgtgacctcctccactgagagg

SEQ ID NO: 75 - DNA, 793 bp, Homo sapien
tgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcarattgagtaattcagaaaaactcaagatttaagttaaaaagtggtttggacttgggaacaggactttatacct

SEQ ID NO: 76 - DNA, 461 bp, Homo sapien
accttgcactattcccctcagtccatctatcgaggtctttgcaggaagcatactgggaattgaaacgagagcctaaatgacatctaagaaaggcagtgttcaataccaggtattaggtgaggatgggattctaaggacatcagtgggaggcagggagccaccttcagacctcagcatggaagcttccaagatccagaggaagaggcaacagcactgagagtcataggtagaagaatcatcacagccctgctaaccaggcagctgatgcccctctcccctggctccctgtgtccaaatcctacaggggcatctgttggctgaactcaacctgaagccaaagagaagatgagtggagagaggcaacatttatagagctcaggtttctagggctggagagggatctggagggacacacaggagacacctggcataaccaaaaaatgattaaaaaaaaaaaaaaa

SEQ ID NO: 77 - DNA, 642 bp, Homo sapien
ggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaaaaaaaarawawattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaact

SEQ ID NO: 78 - DNA, 519 bp, Homo sapien
gcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaaggcgcacatgactccaaaaaaaaaaaaaaaagggcggccgccaccgcgggggagctccacttttgttccctttaatga

SEQ ID NO: 79 - DNA, 526 bp, Homo sapien
gtctggaggcggtgtcctctccgccctgtcgggtcctggatgagtacgagttatggtcacggtcacagcctgatctcttatgtgttcatagccattcgctctcccatcagaactgtttgtcctgaatgtgttcctctagttctagaaaatgaccactaatttaaaaaactcggttgtgaggtttgcccagaggcacttgttccagaatttcccctcctgcttcagccatgtccttgtcacttggcattctaagctaaagctttagcttcccaattcgtgatgtgctaggccaagattcgggagctgttgccagcctcgtcaaatatggaagagaaacaacctgcggtcaaaagggagtgatttgttaagtggtgcgcgtctatctcataactagatgtaccaaccagggaagggccaaggatggaaaggggtaacttttgtgcttccaaagtagctaagcagaagtgggggagcagtttagccagatgatctttgattaggcaaacattgagttttaaagaggctg

SEQ ID NO: 80 - DNA, 281 bp, Homo sapien
gttatattagtgggtagtgtaacattttatccaggttggggtgaggggagatggccacagtagcaagtggtgacactaaataccattttgaaggctgatgtgtatatacatcattactgtccgtagcaatgaaggatacagtactgtgttgtgggtgagtgttgctattgcccagcattaatatttgggtgtgtatgtttgaggctatgaaacacgcaggagtgtttttgtgctattaattttaagagaaagcagctttttcttaaaattcactgttgaga

SEQ ID NO: 81 - DNA, 405 bp, Homo sapien
  misc_feature (1)...(405): n = A,T,C or G
gtgggtgggagcgcgtgctgttgggagttgcttggaggttggcggcgcggggctgaaggctagcaaaccgagcgatcatgtcgcacaaacaaatttactattcggacaaatacgacsacgaggagtttgastatcgacatgtcatgctgcccaaggacatakccaasctggtccctaaaacccatctgatgtctgaatctgaatggaggaatcttggcngttcagmagantcagggatgggtccattatatgatccatganccagaacctcdcatcttgctgttccggcgscccacttaccccaanaaaccaamgaaatgaaccttggctactacttttcaatcctcaaakcttttcacavhtgaccttccttcctaacattctttmtgataaacatttattaag

SEQ ID NO: 82 - DNA, 547 bp, Homo sapien
tagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagtkgtcacagtaaatatcttgttttttctatg

SEQ ID NO: 83 - DNA, 529 bp, Homo sapien
ctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgcccggcctgaatcccatttctacagtaacag

SEQ ID NO: 84 - DNA, 527 bp, Homo sapien
cccatcaccagaatcccttcatgggagggatggatgcctgttgaaactcactgacctattggactgacgctggggtggtatcttcatcagagctattgtaagtcatccaaaaggcttctgacgaaagaacaatttttaaaaagtccctcttttcaatcaagccaatgtcctattttatttctaaaagttttgggactcgtgctgttatcaagtacaatgaaaatggctttataaatagctgttttgacattgtgatagaaggcttgaatacggaggaaagatgtcgctggagctagtcctgagttccgactgtccctgtggtgggaatccagtctgggaaagcaggactgttttagcaaacgtgtactcgttctataaaaatggaatctgttctgcaggttaccgtccctccccgcccaagcatcccctctgtcctgtctctctgctgctgggacccagggctttttcagctgcagaacccactggacttccaggaatcaaggaaaaagtggaaatgtccaactgtg

SEQ ID NO: 85 - DNA, 401 bp, Homo sapien
cagtgtggtggaattcccaagatagaaatgaaaaactcttttatagagtgctgacatctgacattgagaaattcatgcctattgtttatactcccactgtgggtctggcttgccaacaatatagtttggtgtttcggaagccaagaggtctctttattactatccacgatcgagggcatattgcttcagttctcaatgcatggccagaagatgtcatcaaggccattgtggtgactgatggagagcgtattcttggcttgggagaccttggctgtaatggaatgggcatccctgtgggtaaattggctctatatacagcttgcggagggatgaatcctcaagaatgtctgcctgtcattctggatgtgggaaccgaaaatgaggagttacttaaagatcca

SEQ ID NO: 86 - DNA, 547 bp, Homo sapien
gaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgcca

SEQ ID NO: 87 - DNA, 530 bp, Homo sapien
atggattcgaaataccagkgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacrtgggaggccatggagaagtgtaaagatgcaggattggccaagtccatcggggtgtccaacttcaaccacaggctgctggagatgatcct

SEQ ID NO: 88 - DNA, 529 bp, Homo sapien
acctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgt

SEQ ID NO: 89 - DNA, 547 bp, Homo sapien
gtttatatatatagcgaataaatctagttgtataaatttttaaatgccgtcagtagaaagcacacaaggttatgatttttttaattactggcttctgatttctttcacttctgatccttttcctttttctcagatgtagctgagtcttgatcattttaagacaacgatgggtagaattttgagattaatgttaattttccctttttgttaatttcagtcccctctcactatgcttttgtccagaaggatcaagaattctaccatcccttgggtctttgtgtataaacaatgttaaataaaggtagactcagtctttaagatattagacagtttttttagtccatgggattgtaaatataaacattaactttcctataagaatattttggctttgtaatctatagcctcaaattggtatttattatggattcactagacaaacagctgtttccttattgtcttttttctttagtgtttctgatttgctatcagtagctgtttttaaagccatccaaggaaaataattatttacagtttttgaagtcac

SEQ ID NO: 90 - DNA, 528 bp, Homo sapien
gagcagcagaagctgtacagcaagatgatcgtggggaaccacaaggacaggagccgctcctgagcctgcctccagctggctggggccaccgtgcggggtgccaacgggctcagagctggagttgccgccgccgcccccactgctgtgtcctttccagactccagggctccccgggctgctctggatcccaggactccggctttcgccgagccgcagcgggatccctgtgcacccggcgcagcctacccttggtggtctaaacggatgctgctgggtgttgcgacccaggacgagatgccttgtttcttttacaataagttgttggaggaatgccattaaagtgaactccccacctttgcacgctgtgcgggctgagtggttggggagatgtggccatggtcttgtgctagagatggcggtacaagagtctgttatgcaagcccgtgtgccagggatgtgctgggggcggccacccgctctccaggaaaggcacagctgaggcactgtggctggcttcggcctcaacat

SEQ ID NO: 91 - DNA, 547 bp, Homo sapien
atataccatttaatacatttacactttcttatttaagaagatattgaatgcaaaataattgacatatagaactttacaaacatatgtccaaggactctaaattgagactcttccacatgtacaatctcatcatcctgaagcctataatgaagaaaaagatctagaaactgagttgtggagctgactctaatcaaatgtgatgattggaattaraccmtttggscyttgraccttymtwrgraaaawgrmccmacctttyttaacmtgraccwccytmatctctagaagctgggatggacttactatyctkgttwatattttaaatackgaaaggtgctatgcttctgttattattccaagactggagataggcagggctaaaaaggtattattatttttcctttaatgatggtgctaaaattcttcctataaaattccttaaaaataaagatggtttaatcactaccattgtgaaaacataactgttagacttcccgtttctgaaagaaagagcatcgttccaatgcttgttcactgttcctctgtc

SEQ ID NO: 92 - DNA, 527 bp, Homo sapien
  misc_feature (1)...(527): n = A,T,C or G
gctggctagtaggggaacatgtagtagccaagcccatgcattgcagtgcacagagcaacattggggtaacaggatgggtacctgtcacggcctgtgcaaacataacatgtgtcaccacactgaaggtatggtggaacaagtggcctcaccaaggtcggaccccaatggactttttgcctcttgggagcttatgggtctatgaggacacagtagcctttcctatcagcaaactggagtggatgttgtatctgggggtggccttatgtacctgctactgttctccccacattgcccagatgcctgtataactgggaggcactgkgctctcagtttttgcgaatgtgatgagccccctggtgtttctacccttttggcaatgactatccctggagncatgtgtcaaaactgtaaagcacaatttactgctctttgcggagcacaccgctcatgctctgaattacacctgaktgtccctcctccwgktawtgaatgaggttgatcnvatcagaaadgtggkgttggcmata

SEQ ID NO: 93 - DNA, 531 bp, Homo sapien
ggtattcatacagccttcctaaaggcaatgctttccacaggatttaagataccccagaaaggcatcctgataggcatccagcaatcattccggccaagattccttggtgtggctgaacaattacacaatgaaggtttcaagctgtttgccacggaagccacatcagactggctcaacgccaacaatgtccctgccaccccagtggcatggccgtctcaagaaggacagaatcccagcctctcttccatcagaaaattgattagagatggcagcattgacctagtgattaaccttcccaacaacaacactaaatttgtccatgataattatgtgattcggaggacagctgttgatagtggaatccctctcctcactaattttcaggtgaccaaactttttgctgaagctgtgcagaaatctcgcaaggtggactccaagagtcttttccactacaggcagtacagtgctggaaaagcagcatagagatgcagacaccccagccccattattaaatcaacctgagccacatgt

SEQ ID NO: 94 - DNA, 547 bp, Homo sapien
  misc_feature (1)...(547): n = A,T,C or G
gttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtn

SEQ ID NO: 95 - DNA, 1265 bp, Homo sapien
gtggtcaagcagtgatttttctgggactgcagaagttcctgctgtgcccaacctttattactaactgggaaagacccagggagactgggatgggctcatgattctacatacagaactcatccaagaaaggaggaaaagctgatttttgtgaacgtcgctacttgtgcctgaactaactctcaggcacattagtcagaaaatactacctatggttactcccccaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacgtgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctrcagcgtggggttgtggtcctggccaagagctacaatgagcagcgcatcagacagaacgtgcaggtttttgagttccagttgactgcagaggacatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccaga

SEQ ID NO: 96 - DNA, 568 bp, Homo sapien
ccagtgtggtggaattcggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatattttt

SEQ ID NO: 97 - DNA, 546 bp, Homo sapien
ttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgc

SEQ ID NO: 98 - DNA, 547 bp, Homo sapien
tactgggtgccaagctatgtgccaggcactttacatgtattgatttaacacttaacagccactctatattattccctttttacagatgaggcaatttaagctcaaagcatttaagtagacaaccaacctagaatcacatagcaaatgacagaagccagaggcctcccaagtctctctaactccaaaccctatgcttactctactatatcacactaccttgcaataggacaaagggaatatgtggtaaactatgttcccagcatctaaaagccaggagtggttttcatttttctttaagaagatgatagtgtgatttgaaacatatctgaatttcagaagaggggacttttaaaaattgccactcataaggaaagaaagaactttttcacatatttttgaaagaaacgatggtgagaagatattcttgataatagagatatgctaacatttgctttgggtgttttgtaggttagatttttttggtgtgtactttataggcttgcatattgcttactttaaacagctgaagttctaagtaagagtgttc

SEQ ID NO: 99 - DNA, 122 bp, Homo sapien
cagcctttctgtcatcatctccacagcccacccatcccctgagcacactaaccacctcatgcaggccccacctgccaatagtaataaagcaatgtcacttttttaaaacaaaaaaaaaaaaa

SEQ ID NO: 100 - DNA, 449 bp, Homo sapien; identical to SEQ ID NO: 10

SEQ ID NO: 101 - DNA, 131 bp, Homo sapien
ccatgttctctcttgactacgcatatgtgagatttgcccctccgccccgctcgtgatagccatccagatcttttacctggccctgtcttggagaatctgttttcaatctccactgattgcccccttgctgg

SEQ ID NO: 102 - DNA, 199 bp, Homo sapien
ctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttgaaaaaaaaaaaaaaaaaaaaaaaaaaaaaaaaaaaaaaaaaaaa

SEQ ID NO: 103 - DNA, 321 bp, Homo sapien
ttttttaggtttttaaactttttatttgcatattaaaaaaattgtgcattccaataattaaaatcatttgaacaaaaaaaaatggcactctgattaaactgcattacagcctgcaggacaccttgggccagcttggttttactctagatttcactgtcgtcccacccccacttctttcaccccactttttccttcaccaacatgcaaagtctttccttccctgccacccagataatatagacagatgggaaaggcaggcgcggccttcgttgtcagtagttctttgatgtgaaaggggcagcacagtcatttaaacttgat

SEQ ID NO: 104 - DNA, 309 bp, Homo sapien
tttttttttttttttatttttttttttgcatcaaaaaactttatttccatttggcccaaggcttgttaggatagttaaaaaagctgcctattggctggagggagaggcttaggcaaaacccctattactttgcaaggggcccttcaaaagtctctgggcttctatttcaaccgcgatgatgtggctctggaaggcgtgagccactttttccgggaactggccaaggaaaagcccgagggctacaaccgtttcctgaaaatgcaaaaccagcggggcggccgcgctcttttccaggacatcaaaaagcca

SEQ ID NO: 105 - DNA, 591 bp, Homo sapien
cttatttctgcatgggtcggagagtgggcgggactgctttactgagttatagtgaatgtagttttaacctaagcgcctcacatgactaactcctcatccatcaagaatgagctcagctctcacttccccactcctcacccccctgtaaagtaacctttctccaaggttatgcttcaacaggaatagctaacatttattaaattgtggcacgtaagtatcttggatatattggctcattgaatcctcacacctactattttacagagatgccagtggggcttgagattgaatcacttgcccaggctcccactgctggtaaacagtagagggggctcctgacccatcagtctggcttgacaacccattccctcaactgcggatcccggattcccttatcaccctgttgatttctccataggctgtggtaacatttgttgcatgaatggaccgttgaaatagggcctggcagggagaaattcaggaaatgaatgaatggttcttccctggcagcctttgatgacttacaagccccttcaagggggaaagccatttttctccctgggactccttgaaagcccgggagccctgcct

SEQ ID NO: 106 - DNA, 450 bp, Homo sapien
ctgccactcctgcctctgctaccccgaaaccggagagggagctcaataataacacaggtcccactaaactaattaaggtgttggcataacctgtcattgaattcaagtgtccaacaactgtttgcttaaaatatcattagacctaatatttttttcaaaggcacaaagtttaaacatggggggggcgggtgttgagaggggtctgggatacccttaaacccaaaaaagtgatttgttcccccttgcccagaagggtgactgttccactgggcctgtcaccacaggacattttccatgacaagcactcaccttcttggggaaggggcatcaggttggcacaggaaaggcccaagtgaggggccactctgtacattaatactttggtgattaatgtttggggagaggcaggattctcacccacctttttgacttcaaacactctcactcaag

SEQ ID NO: 107 - DNA, 116 bp, Homo sapien
tcgacgaaagttactgtcactcagttgtaaatccatcagcttttcacctgttaaaaattttgcaaaatatacatgttctcctcctgttttcaattcttccatcttttttcttgagg

SEQ ID NO: 108 - DNA, 291 bp, Homo sapien
ctgctcgaagttgtcaaaacccacgtgcagggcaatggagagtccgatggccgaccacagcgagtagcgtcctcccacccaatcccagaactcgaacatgttttgagggtcaattccaaactccttcactttggttgtgttagtagacagggcaacaaagtgcttcgccactgcagtaggatccttggccgcctggagaaaccactccttcgccgtctctgcattcgtgatggtctcctgggtagtaaaggtcttggaggcaatgatgaacagggaggactcggggttcag

SEQ ID NO: 109 - DNA, 662 bp, Homo sapien
gctgtttccacagtacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaaagacagctcctggaccttgccccggggcggcccgctcggaaagggggcgaaatttcttcaagaatatttccatttccacaaacttggggccgggggccc

SEQ ID NO: 110 - DNA, 323 bp, Homo sapien
tcctgtgaaacagcccattttcctacctactgtgggttgctgctcaggaggaacgatatacgccaatacaagcaggaaatctgcagctcctctgctatgtgcctcagaacactttcaatttttctggtcaatgctctgattaggtatcatacataaaagccagcatattagtttaaatctctaacaaaaaactatattttccaaagtcattatcatttgggccaattaagtgatcttttcgtgctttgttgagcttcatctttagggcatctcttctttcttcccattcatgaagttcggcatttccatgtgcaaatttacag

SEQ ID NO: 111 - DNA, 336 bp, Homo sapien
tccagtgcgctccagccttatctaggaaaggaggagtgggtgtagccgtgcagcaagattggggcctcccccatcccagcttctccaccatcccagcaagtcaggatatcagacagtcctcccctgaccctcccccttgtagatatcaattcctaaacagagccaaatactctatatctatagtcacagccctgtacagcatttttcataagttatatagtaaatggtctgcatgatttgtgcttctagtgctctcatttggaaatgaggcaggcttcttctatgaaatgtaaagaaagaaaccactttgtatattttgtaataccacctctgtgg

SEQ ID NO: 112 - DNA, 218 bp, Homo sapien
tttttttttttttttttttttccagtcaggagtatttttaatcactgtctacagagacacctacatacacacacgggtggggaatgaacccaaagtttttaggtgaagtctctcagggcccaccccgtgccacagaccttcctcggttgcagagattctgggcaaagcatccgtgctctcatgagattatcctggggagatttagaagaattttgtgg

SEQ ID NO: 113 - DNA, 533 bp, Homo sapien
ctgcaccgacagttgcgatgaaagttctaatctcttccctcctcctgttgctgccactaatgctgatgtccatggtctctagcagcctgaatccaggggtcgccagaggccacagggaccgaggccaggcttctaggagatggctccagaaaggcggccaagaatgtgagtgcaaagattggttcctgagagccccgagaagaaaattcatgacagtgtctgggctgccaaagaagcagtgcccctgtgatcatttcaagggcaatgtgaagaaaacaagacaccaaaggcaccacagaaagccaaacaagcatcccagagcctgccagcaatttctcaaacaatgtcagctaagaagctttgctctgcctttgtaggagctctgagcgcccactcttccaattaaacattctcagccaagaagacagtgagcacacctaccagacactcttcttctcccacctcactctcccactgtacccacccctaaatcattccagtgctctcaaaaagcatgtttttcaagatctaaa

SEQ ID NO: 114 - DNA, 261 bp, Homo sapien
  misc_feature (1)...(261): n = A,T,C or G
ccatatctgctcggcgctacttctttcttggattgatcctgantgatgcattggcgatgcctttggagaaggacatgtgatgtgatggtcttcacgttccacatgtactcgggcaaatagggggacaaactgaagttaaacaggtcgaaactagaggagctgctgaccctggagctgaccactttcttggggaaaaggacacatgaaggtgctttgcaaaagctgatgagcaatctggacaccaacataggacaacaacgt

SEQ ID NO: 115 - DNA, 267 bp, Homo sapien
cctctcctgtgggttccagaccctgttccagcaacaattgctgggacacctgggccgactgctccacctcgccaggccctggccctctccatctcagccctgacagccacccagtgataaacacagcaggcttcctaagcaatgtgacgcaccagaggggtggtggtacacgttccccttgaagtcatctgaaaattagagaacagatttgcctcatagctgaagagagaccctattccaagcatgaatggccttgacaatgttcct

SEQ ID NO: 116 - DNA, 239 bp, Homo sapien
ctgatgacctggggtctagtgaaaatgcagggtcagattcagtgggtctggggtctgaatctctaaggcgctgccaagtgatgctgatgctcctggcttgtggaccaccctgtgtatagcaaagctctagactaggaggtctcaaccttggctgcacagaattatctggggagtttttaaatttcccagtgcccaggctgcattcatatcatagtagagacagggttttgccatgctgg

SEQ ID NO: 117 - DNA, 168 bp, Homo sapien
aaaaaacttttatattgctgcatcttccacagttctttgggtagtctctgaacttaaaatttgtaggagttgtagactacctaaatttttaagttatggatttgttcataggttgtaggggtaggtaaagaaggaaacagacaagaaaatggcttcttgaggtggcag

SEQ ID NO: 118 - DNA, 150 bp, Homo sapien
aaaaaaaagagtttatttagaaagtatcatagtgtaaacaaacaaattgtaccactttgattttcttggaatacaagactcgtgatgcaaagctgaagtgtgtgtacaagactcttgacagttgtgcttctctaggaggttgggtttttt

SEQ ID NO: 119 - DNA, 154 bp, Homo sapien
aaactgtgtgagatattaaccagccgccctgttataaaatcaggaaatccaaacagcgatttacaccgattaacacccccttttatattttttcaaatacactgagaaaataatcaaacgttttcatctctcttgtctttttttgttttttcct

SEQ ID NO: 120 - DNA, 314 bp, Homo sapien
ctgcgtggagtgacgggaggagggaatcactgtgtgtgcgagagtgcttcagactcaatttccaaaataattttcacccctctaagcatgtaaattcaaagatggatccttcatagaaattaaaaaatcaatttgagctcatttcgaatacagaacaagtatggcacagatggaagtcctgccacgtttcctttaatgatgctgactcttgtatcacacaggccagcatgaagtttcttactcagactttacaggcattttccgtaattcaatcagtcctgctcccagcacaacacaggaggtgattcgagaat

SEQ ID NO: 121 - DNA, 601 bp, Homo sapien
aaaaaaaacctaattcattgaagtaataaccaaataattttcaatcttgattcaactgtgattcaaatcttacaccatttgccccttctatgaatttatgtataaaattttttaagagtcagagtttttttttcttgattaattggatgtatttcacagaatttccaactgctcacgttagttttcttccttttagagttgatctctctaatgtattagatcttcatgcctttgatagtctctctggaataagtttgcagaaaaaacttcagcatgtgccaggaacacaacctcaccttgatcagagtattgtacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaacgacaaatcacaacaagtgattgtccagggtgtccatgagctctgtgatctggaggagactccagtgagctggaaggatgacactgagagaacaaatcgattggtcctcattggcagaaatttagataaggatatccttaaacag

SEQ ID NO: 122 - DNA, 486 bp, Homo sapien
ctgtttctaattgcttttgtgactgttaccttttagttcatgcccccccaaagagctaaatttcacatttttacctacaaaattgatttttaattcctgcaaataatttaccattatgagctacaaggtgggcaacagcgcctgaggatctaattttatgcatattactcccaagtattttaacacttgttggagaagcaatatctggatcaataaaacactgtcccatcaaccatttgagtggggagagggagaagctcttctgtaagtaagattctggcaagctctttgaaatgagtcttctttcccacagattttctctactctttcaatacaaacagataggagaagagggaatagaaacctggaggaacttgaatatttttgttctagatagagatacagttattgaaaaggaaacctagaaagtagtcacacgtcgcttatttaggccagaagtaattgtactgggcaaaaatttcactt

SEQ ID NO: 123 - DNA, 239 bp, Homo sapien
ctggtgggtctttttttcctctcagagctcaagcctgtagtgcctgatgtcatttctttcaagttgcccacagtatctccacttaaactaggctagtaaccaaaataatgtggaccttctttaggaaacagtgtgggagaataggagtccagccgtaagataaactggaaatatttgggcgtcttgtacctggctacgcaccacctcagtgttgttcctacataaacaaggcccctttt

SEQ ID NO: 124 - DNA, 610 bp, Homo sapien
  misc_feature (1)...(610): n = A,T,C or G
ccanccaagtcnttgatgatcactgacccncgcgcgcctgctggaccaaggtggctgcggggaaatcgccacngngctttcggttttcttggtgaaggaatacaccgcgccgacagcaggttttcagtcagggtcagggactgttgcttgcgcgcgaaaatcaccggtacgccgaggttcaggccggtcatgatcgccggtgcaatgcccgaggcttcgatggtgacgatcttggtgatgcccgaatccttgaacaacgcagcgaattcatcaccgatcagtttcatcagcgccgggtcgatctggtggttcagaaaggcgtcgaccttgagtacctgatcggaaagcacgatgccttcttcgcgaattttcttgtgcagtgcttccacgaaagcttcctctgttggcgcaacacgcgccgaaagtagattaaaaagtagtcgattctagcgctttaacatcgcgcgtatatccgccagggcggtattgccgcgaacggctttgacttcggttggtgtgtcgtcgttgccttcccatgccaggtcatccggcggcagttcgtcaaggaaccggctgggggcacaatcaatgatctcgccgtactgcttgc

SEQ ID NO: 125 - DNA, 196 bp, Homo sapien
ctatagggctcgagcggccgcccgggcaggtaaaaaatcagcccctaatttctccatgtttacacttcaatctgcaggcttcttaaagtgacagtatccttaacctgccaccagtgtccaccctccggcccccgtcttgtaaaaaggggaggagaattagccaaacactgtaagcttttaagaagaacaaagtttt

SEQ ID NO: 126 - DNA, 247 bp, Homo sapien
aaattagttaaaaaaatgcattcctcatttgatatagccacattccaaatgcttaaaagccgcatgtatctagtgactaccatactggagagtacaaatatagaactttacccgtcactgcagacagttctgttggattgtgcagcattggacaatatatacagtttgcctgtatatgagaaagagagagagagagagagtgtgtgtgtgtgtgtgtgtgtgaagtgcaataaggctgacaggcatc

SEQ ID NO: 127 - DNA, 590 bp, Homo sapien
cctccacggcatggcgcaattgttgttcaggggccgccaggttgctgcccatgccgatgtagatacgttccacgtgcttactcgccagacgcactcgaagcgtcgccagcgctacgtttgcgcttgctgccactgctgcggcgacgctttttcgggccatcgccggtggcttcgcctttgctgctgagctctttgatcatctcgcggcgctggctgtcgttggcgtcctggtagtcggtccaccactcgccaaggccgtcggtctgttcgccggcgctttcacgcagcagcaggaagtcatagcccggcacggaagcgcgggttgtccagcaacaggtcggcacgtttgccgctgcggcgtggcaggcgctcctgcatgtcccagatttcacggatcggcatggtgaagcgtttcgggatggcgatgcgctggcattgctcggcgatcagctcgtgagcagcttcctgcatggctggaattgccggcatgccacggtcttgcaggcgcatgacgcgtttcgaaagcgcgggccacaacagggcggcaaagaggaacgccggggtgaccggtttgttctgcttgatgcgca

SEQ ID NO: 128 - DNA, 361 bp, Homo sapien
ctgcccatggaaaccctccaggagctgctggacctgcacaggaccagtgagagggaggccattgaagtcttcatgaaaaactctttcaaggatgtaaccaaagtttccagaaagaattggagactctactagatgcaaaacagaatgacatttgtaaacggaacctggaagcatcctcggattattgctcggctttacttaaggatatttttggtcccctagaagaagcagtgaagcagggaatttattctaagccaggaggccataatctcttcattcagaaaacagaagaactgaaggcaaagtactatcgggagcctcggaaaggaatacaggctgaagaagttctgcagaaatattt

SEQ ID NO: 129 - DNA, 546 bp, Homo sapien
aaaaatacaaattcagtaagacttttgctctaacaacaatttttcaaaacgaatcaacaacaaaaaagtatccagtgtttcttttcttatgaagatataataaaacacagtattggtaagcacattttaacagtatgcttttcttttgtagggaaaggagatatggctatgtctaacatcgtgggatccaatgtgtttgatatgttgtgccttggtattccatggtttattaaaactgcatttataaatggatcagctcctgcagaagtaaacagcagaggactaacttacataaccatctctctcaacatttcaattatttttctttttttagcagttcacttcaatggctggaaactagacagaaagttgggaatagtctgcctattatcatacttggggcttgctacattatcagttctatatgaacttggaattattggaaataataaaataaggggctgtggaggttgatattattaatagtgttatgcagaaaatatgaatggcagggaggggcagagagaaaaatccatttcttcattt

SEQ ID NO: 130 - DNA, 733 bp, Homo sapien
  misc_feature (1)...(733): n = A,T,C or G
ggggcctcttcctaaaggcactaatcccatccaatagggcttaacctcatgacttaatcaactttcaaagacaccacatcctaatgccatcacatcagaatttaggcttcaacatatgaattttggggggacacaaacattcacctcatagcattcattgtttcttgttattggcaaagccaagactcacattgtctaagttatttgacttttgagtccgcagatgtgaaaacagtgctaaacagtccagcttcatgagtggagaacagcatttgtgacaaccaccaaagtacctctgtggtcagtgtcctcaaccagggcacagcatcatggaccagagcctctgcagggcacagaggagtggtgaggaacaggggctctggagcaaccccacttccctctgctttgtatatggggggttctgcacatgactgcatttgaaaagggcttcactgcgcttgctgaaggagtgcacttgagctagcggagagttcccagagggtgtctggaagaagcaaaggctattctttgtttcactcagttatagatggaagtcagacacttctgcctgaagtactttcacacactccacagtcttaagaaggatgganaaagcatgccaactactcanaaaaccacaggtgttcaagcaatggtatccttttatncctacaactagtggacaaagnggggcctctgtaatttgggaaagctaggaaaactttttctgggg

SEQ ID NO: 131 - DNA, 305 bp, Homo sapien
  misc_feature (1)...(305): n = A,T,C or G
aaacacatacgaatanttnaactgtgattatgaagtgacagccggctaaatatgtcttgtattttctctcttcctttttttgctaactcatcctttattccattcctgcttccatggtaatgcaggctcaaataaattactaggatacaagattacttcaagcctcttttctgtggaactcataatatgataagcatttgttacaagattgcctgtagttgtttaggggacaaattatattagggaaagaaagtctttctttagttggttaaattttctattataattgggtactaaatttattt

SEQ ID NO: 132 - DNA, 545 bp, Homo sapien
aaacaatgctacactcatttttggcaaagtgctgtattgttcagtctgtgtacaaaactgaccatctatgaaccaatcagtataaaaaatttctataaaaacaaaatttagacagcggctcaagaaaacaagctgccatttatgcatagattgatgtacagtaacctaaccaaatgtcccttttgaattttcaagttactgaaaaaaaatgtgtcgagaaacacattaagaaggcacatgtacagtctacaatactcttcagtctccctaactcatgccctgcccctataaaggaaatatgttcacaattttacttgagaaaaaaaaacaaagccacttaaaaaaaaaaaaacacacacgcaattattaaagttcaaaatctctggaggaaaatacaagcaaaaccactcatacactccaagcctgaaacacacatctaacctccccaggtactggtttggttttcagaggtccacctagaaaacaaatctaaaacttcaggcaaaacagagcaaaactggacatttaacaattacacaattttt

SEQ ID NO: 133 - DNA, 330 bp, Homo sapien
  misc_feature (1)...(330): n = A,T,C or G
aatatttattactaatatcttataatgttttgtggnaccatggcataccttgggtactattgtaacanatagttcaggaaaccctactataaggtttatcaaatggtctcataaacagttacttattcaagcacgccaaagctcagtgaaaagtatttttcacccttactctttctcgtgtcattcaaagagaagttttgatgtagtgtatttatttgtagggagtaatgaacagatccatttcacagtagactttgtgctctaggtgatgcagctaattgccccagtttggaaaacatggacttggatgaattgtcttttgtttgggac

SEQ ID NO: 134 - DNA, 627 bp, Homo sapien
  misc_feature (1)...(627): n = A,T,C or G
aaatattacttcaaatacattttaaagctcaacaaacttgtgttgaactgaattgcagatcctgaactctatttgaaaatacatcatgaaacagaaaancccattccaaatgaaaatgatagtgctttgttgggggtgggaatgaggcggggagactaaatcactattaacagacttcttttcccaatgcaatttgtcaaaagttcaaaagttctgaaatgtactaaatcttaagcaaattaaattcatgatattactaaaactttttaaatagtgcaatgacttatcaagttatagtggctgcattaagaacaaattattgtgtgaaatacctgtataaacacaaaatacaattaaatatttctttacaaaaagctgagcattacgcataatagtggaatgtctttcattaggtgtattttttaaagattaacaaaagtaacatttcctaaaatgtatacatgtgccatatttttgcaaacatgcctgagaatgtatttaaaacatttctgtagtaagagtttgcaagaacttcacaaacctgcaaataaaatgcatctttttaaaaaggtgaaaatggcatctccacactgcaacaattcaaaaagtgcagcatccctaatcttt

SEQ ID NO: 135 - DNA, 277 bp, Homo sapien
  misc_feature (1)...(277): n = A,T,C or G
aaaatcaaatatattatttgttaaaaatcagcttgtttcattacnggaaattacaccagtccgttctatttactttcaaaccatattcaactcctcaactttcaaacatgtaatcaactaatttcaaaagggaaaaggtaccctttataaaggagagatctgttaagacaccaagaaatcaaaattaatatcacttaataattaagtggataacacatgcctcccaatacagtgcagtgagaaacacaaaacatcaattcccgcgtactctgcgttg

SEQ ID NO: 136 - DNA, 486 bp, Homo sapien
aaaacagaatgaattcattgttacagttacagaagtcagaagcccaaatacagtctgcctgaaccaaagccagggtcagcaaggttcctttccactgttttgccaacttctagaggccacctgtattccttggttcatggcccctctcttcatcatcaaataatcagcatagctttatgacattggcagctctgattttgctcttttgccttcctcttatgtagacccttgtaattacattgggtacacccagataaccccaaataatctccctatctcaagattcttaatgtaattatattgggaaagtcccttttgtcatataagataacatagcaatggattccaaggattagtatgtgagtttcttttgaggggctataattaaccctaccacaatatggaaatgtctattgtttttctatgtaccagaaataagacattaggatgtgaaattaataacataacaccacttacggcatcacc

SEQ ID NO: 137 - DNA, 552 bp, Homo sapien
  misc_feature (1)...(552): n = A,T,C or G
ccatcttgcatcaaatgttcttaaggcagtgactggctatcaaccacagtttctgtctccccagttgcaaacacaggatccatgcaacagttctgagaccatacacttagaaaccacaggggatgcggatcaaatgcagaactcccaaattataaaacagtcaggctacactcaaaacaaaacatagaacatcaacaacacacatctcccaaaaaagaagtgcaacgcatgcttgtataaaccaacaataacaaaaaaaccacaataaaaaatgcagagtctcccaaacaagttttcaaatgtattgcanaaagaaaaaaaatgtatatatatataaaattaaaaagtctgaaatactagtgcatagtcaattacctaacaccaagtttcttttctttctgtccaagctctactgcccctctgatactagcagcatgtctacaggctaagaccatagcagcaaaaaacgtttttcatttggcatttacaaaattaaattactgaataaaaatataattttttataaaactatttcttacagtaataattttt

SEQ ID NO: 138 - DNA, 231 bp, Homo sapien
aaattttactagtgttacttaatgtatattctaaaaagagaatgcagtaactaatgccctaaatgtttgatctctgtttgtcattactttttcaaaatatttttttctgtaaagtataatatataaaacttcttgcttaaattgaatttctatattagtggttaattgcagtttattaaagggatcattatcagtaatttcatagcaactgttctagtgttttgtgttttt

SEQ ID NO: 139 - DNA, 535 bp, Homo sapien
cagttgccaaccctctgaaccgtttaggccggttcatcgctgcctttgaatctgggccggtggtgatccggcaaggggtgaaaccaaagagcgggggctgtgaggcccttcgcagtccctcgtaagtcgctgcgatggagtgaactatcacgcatcgtgtttatttcgtcaacacgaaatgtgatttatttttgcgaattaacacggcagttctcggttacgttttcggaaagcgtgggatatgattctgtctatcctgtacggatatacagtaattaccgggaggggattccatggcgaagaagcaggcggcaccggcagcacggcaggaaatgagcggtatggcgcgcctcgggcttcgcgtctcatcgatgattaatcacccggtcgcccagacgcagcgctgggttacgattcatcgcctggacacggatggggatcgggagtgggaagaggttctgagcgtgatcgctgataccgacgagctcgagctgacgctcaatgacgatggcagtgtgacggtgaggtgggagca

SEQ ID NO: 140 - DNA, 640 bp, Homo sapien
  misc_feature (1)...(640): n = A,T,C or G
acattggtggcacttgaactgagtgcaaaccacaacattcttcagattgtggatgtgtgtcatgacgtagaaaaggatgaaaaacttattcgtctaatggaagagatcatgagtgagaaggagaataaaaccattgtttttgtggaaaccaaaagaagatgtgatgagcttaccagaaaaatgaggagagatgggtggcctgccatgggtatccatggtgacaagagtcaacaagagcgtgactgggttctaaatgaattcaaacatggaaaagctcctattctgattgctacagatgtggcctccagagggctaggttagtacaaactcgcattcatggcttggtttcccagaagatctccatttaacttttttaaagaaagtttattgctttctttaacctgcattttttctaagttttttttcgcataaaggtgctgtctttgtggcaaggcctaggcatgacaatcggaggactcgagggggatggaggactagtgatccggctggctgcttccagtcgattagagaggtgaaaaagctgaacgtgtgcccantnaatcttcaaaaaggcagaaacatatcaccttntgcccccntaaacttgttctttttccgaaggggaaaaaaaaaatggaaa

SEQ ID NO: 141 - DNA, 127 bp, Homo sapien
aaaaatcacacactgacaacacagaaatacgaaatgctaggaaaagtctagcatatgaaggaaaaacatgtcttatgcactctaatataattttttcaattagtataaaggcaaatgcggttttttt

SEQ ID NO: 142 - DNA, 126 bp, Homo sapien
  misc_feature (1)...(126): n = A,T,C or G
aaatatcctctggatgcnttcaagtaatactaatcatttcatgngnaaaagtcttttaataaacaaattcagagtaaaattaattgaaatatttataatacatttgttacacagttatttccaata

SEQ ID NO: 143 - DNA, 730 bp, Homo sapien
  misc_feature (1)...(730): n = A,T,C or G
gcaagttctggagtgttcacttctgagcctgaattccctcccctgcaaaatgggggaataccctcctcagagggtccctgcgagggtgaggggagatcagcatggcaggtgtgctgggcacggcagggcctgggaagggcagatcctttccccatccctgccacaaacaacccaaacctttaaaggagagcaatggccttgtgtcaaaaacaaaaacaaaacaaaaccctgtcctaggagactggggccctaatttctaatagcaagcctttatgagtccctaacactctactgggctgagtatctcacacgccagaggataacctgccttctgctcaccaccaccccgtagtagttgtcattgtgtccatttcacagatgaggcaaaggctcagaagagtcatgtgttaaaccagcttctagagcccatgcaggagctgcaggtggggagaatcacctctaggtgctcttcccatggaatcctcaccctccttgagtggtcactcactcanctttccaatgggtgtgtgacctttgaccagctttctttccttntctgggcctcagtttcccaccttggacaaagtaagaggtctcttgggnttcanggtagttcttcctaacttcttttccttttcatttgagcatccttcttcattttttgccacctctcttgtcattacangcttttaccttcggccgcgaaccacgcttaagggcnaaatttcca

SEQ ID NO: 144 - DNA, 485 bp, Homo sapien
ctggtcagaaatgattctcttgtgacaccatcgccacaacaggctcgggtctgtcctccccatatgttacctgaagatggagctacctttcctctgtgtggcattttgtcgcttatccagtcttctactcgtagggcataccagcagatcttggatgtgctggatgaaaatcacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctgcaacttctggaagaggagaacaaagaacgtgctaaaagagaaatggtcatgtattcaattactgtagctttctggctgcttaatagctggctctggtttcgccgctagaggtaacatcagccctcaaaaatattgtctcaacag

SEQ ID NO: 145 - DNA, 465 bp, Homo sapien
ccaagacagctcgtttctggagagtatgagggtgtgttttcttattgtgaaaggaactaccttctcttagagggtaggaagaatgtggtgtgtgtgtgtctcataaagcaaccggacattataggtgcccaggtcatctataaaaacgatccttgggctgtgtaaaaatgaagtggcttttcagtatcctctttcacacttgctgcttcgggagactatgcaatgatgggaaggtgattgcccctttatttcattcagtgccatggtccctgttgttgtagtaatttatttgtttagttcattttttttttcttaacagtcaaggggaagagtgattcctcacactgctttcaagctggactgagccagtctcattctgggaaagaaatgctgtgtccagaactcagcagctccatctattttttccagtcgaaagaaactgatctttaggcagtttttacttgg

SEQ ID NO: 146 - DNA, 351 bp, Homo sapien
ccagccggggtaatctgtatgtggcggacttgagctacgacgtgggcggcaagtgcctgtttgaccagatcagcggcgtgaagcttatgccaactcatcgtttgataaatccgaggatcagttcaagacgtcgcagcgggtgattttgggaacgtcgttttcggtcagtaaattgtgggtagcgacggagtggttgatcggcaagaatgatccgtatattggcgggagcagctataccgagagcctgggggctggggggagtaaccagtgggagaatcagttatatatgaacattgggtactacttctgacttaagatctccagcgttttaactggccttatcgcaggcaa

SEQ ID NO: 147 - DNA, 654 bp, Homo sapien
acttatttttaattactgaatatttcttagacgttttgggacagattttatgtaatctttataagtatgatttctgaagaaaagcaaatgcattagtatgtttgccttaaacttgtagactaaaccaagtattgtaaaataaacagcgataacagtgatagtttttaactctatggtcattgtatcactctggaaaatgtggagtagctgtaataaatctactcctgtattatgctttacagtgcaggtcttagtttttcttttttctcatttcttttgaaatggcatctcgaacaaagtccaccaatccctttacaaaagaatgaactgctcctctgtgtgtacttcatagaaggtggaatcggacagaggcaggttagtgacagttattcctgaaatacaggagcagagtacagtctgttgtggtttcccggattccgcgcctagctcagccaattaagcatgagacataggccattgagccacttagtagttatgcgagtggatagattggtatgtaagagggaaagaggtctgctgtaaagaacaacacttgtttgtctgtggggaaagaaaagcagaatcttgagatgaaagttggcatacaaataggatactatcgccagtaggttatattacaaaacatttatcggg

SEQ ID NO: 148 - DNA, 539 bp, Homo sapien
tgaatatcatgagggtgattttcacctgattgcaaaactgccatagtttgaaacactttttcaatttaccagacacactctgtcaagacttcatatacttccaacttgcaagcctgtgttttgccttctccaacctaaaaaggaaaagctttaaacgatgaacttacattctattaaaccatcagacttgagcttatccatctgtttagcgtgaatgtacaaaccaggtacatttccaccaaacacatagaaaaatcttgtgcatcacagttcagctaagggtagtaggacaatccttacaatcctccttggatttcttttttaagatgtcaaagaagcaggtaagcaacattgttcatttgttactgggtgttctagatcaaaccttcacaagctatatatatagcttcatatgctatagcttacaaatggggtaacaaagtaaaagaaaagaacaaattatactttgacactttatagtcaaagtataattaaaaaagaaatcctacagtgggtaatggagaaatagataatttttc

SEQ ID NO: 149 - DNA, 273 bp, Homo sapien
tttttggtcattctcctcaaggagccgctggatagtagtcttgattgacttccaccttgcccctcatacagtccggtactaaggccaccgacatcccgaggaacctccggaaccacgaccgccaagcaactcgacccacgataggtggggcctacgctctcgaagttgattggatgctcccgcctacagggcggggtacagaagggacgtcatttgtgactggacgcgcaagagctatactcagcagctttcctctgtcccagcccctagaac

SEQ ID NO: 150 - DNA, 200 bp, Homo sapien
gtttttactaccgtatggcccatttaaaagggatgtgtacgccttacactataacccttaaaccacctagaaatatgaaactcaaactgccactgacctccctcaccaagctccataaaagtaaaaaattataacaaaccttattaaccaaactgaacgaacatatgggcgattgattcattgcccccacaatcctaggg

SEQ ID NO: 151 - DNA, 515 bp, Homo sapien
ctgtagcgatctttaagaatattttatatatgaaatctggatttagggttcccatggtctggcaccactgggtacagtagttctacatggcagtaattcattggagttgaagcagtgaggaaagagtcaagtactagtcttttatcctcagtgtccagtgactgtcaagagaaatgggactgccttctgcattgggatatgtgggttaaagagtagtccaatatagaagagtgagaaagtgmaccctctgaggcatagtaatgttttattkraaaacatctcacatgtattgaatacttasataggatgtattctgtattactgaattttccagattattgaagcaatcacctttctgtgtttaaagttttagaaagaatgcttttaaaaatgcttaacataagataagcctgttttcatggtgcaaggtcctttctatgaacatgaatcactggactctgagggttggactaagatcacatctacatcccttttaaatgactagtgtgctcaga

SEQ ID NO: 152 - DNA, 243 bp, Homo sapien
atttcaacaacatacttgtcgaggtagttataaatcttcttagggggaggtggtggtttctgttggaatgccaattttacagcttctgctgctgattcaggttctttaattatgcttttctttgagtctgcttcagatagcacaacaaaaaaatgatgacacttttcacacttgacaaaacgggtggatgatacaaaaggtctctacatgtgtgcacaagtcgccacatttaggacagcgcag

SEQ ID NO: 153 - DNA, 620 bp, Homo sapien
ttgtcttctctaccttaccatagccagttgctttcattttaaaccagagcaagtaacatattagtgacttgaatcttcataagttaaagtaaaaaacagcaaaaaacctagatctttgtcttttagaacacagaccattttcaggaaagcagttagctaagtgtttaattcatgaatattgtatactgcatcccctaccacaatttacacaatcctgtggatagtcctacctcaccctggtcaacctacatgatccttaagctaatggcggatcacgatgaccttgtagacatgcacacaactatacctttgtccaacagatcataatatatctgctatccaactggttttacctgcctaatcctactgatttgggcactgcttgtatagtctctcaagttcacaggaaatgttgattttctaaggtcctcatttttacagagtatacaggcaaagtgacaggggaaaaggaattagtctaagagtaaggggatgattattatattgaggctaaaaccacaaagtggctcaggctttaaaaaaaaacactgtggataatgacaaaaagcataagtaaaaatattttgagaaaaataaagtacaagttttgaacacccccc

SEQ ID NO: 154 - DNA, 843 bp, Homo sapien
cattgttagtgacccaagtaaatttatagtttttaagttcagaggaaaaataaagcctattttttgttaacagtcttaataaataataaaatggaataaagaaaccaaaaaaaaaagaaaaagtttgtatgaaaattcatccctatttctttattttggactaagtagtcaaatttctactatattaatattatgtaagcgacacccatttaaattcactctctttgatagaaaggtgagttgattatcacacctgctattttttcactgccaaaragactgcaataacctccctccatcaccctcaaaaaacaaacagaaaccatctgaggcatagccattgtttacatattgtgtttgtgtgcacctatctacaacgttctttcttctaaggagtttatctgccaatattttcggcttcagcagcagcgctcttcttgacagactaagagaaggatctacagaaaagtcatctgattaaggttttgggtcaaattaaaactctctggacagaatcctctttccttcacttggatttctgcaaacagaaagcagattattctcctggcacaatagcgactctagaaacgcttatgtttttcagactttggcagaacttgttaagaacagcatcatcataatacatttgtacaaactcgaatttcagtggctcttttgtcccacatgatgcatgatgaaatttataaaggtctgttttacccccacagggtcatttcttttgtgttcctacagagccaataggcttcatttaagtccaagttattatattaaccatccctttcactagactagagaacttctttttcatggtccatatcgtga

SEQ ID NO: 155 - DNA, 674 bp, Homo sapien
tttcgtgtcagccccaggtttgctccagctattcacaagcagaatataacacaagaaaaacaattcatatcccttagggaaaaaagaggatcaattcatcactcaatatttaatacagccaaaatgagctgccaaaacaagcacacacacaaatactgtgaacagaaaaatacaagaaaatgactaagctgggagtcttgacggggtatggacattgcttaaagcacttatcagtccccagaaaaaccaaaccaaaaacattttttacgatggcatggcctcatggccccctttaaaactgttgatggtaacaaagggcagggggtggggagagaaaacacaatcactgctccctttttgctcgccagtgtgactgcacccctcacggcaccggcatgtacacaactaccacacaaggaggaccaagtccctctgctggtggcctcctaaaaggcaaggcttgagttttggctgatgagcaagttctctccgttaccaatccctgccaaccagcactaccatggctgaattgatctaccgttttcctgagtaaactgtaactggctacagtttcggtaacatggaaaagaactcagctactacagccaactgcaatacttcaggaaccccctccatccctggggctcctcactcctagtgcatcttgattggat

SEQ ID NO: 156 - DNA, 671 bp, Homo sapien
cctttagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtgggctggggcacaacttttagtctgaggggagctagtagtcggcttgacaattaaagccatccataacaacttttcctcaaatgtgttgactcctcaggggctaaactgctcttagcttagaattatgctttactagagatctaccatataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacattttgcagaattgcagattttccc

SEQ ID NO: 157 - DNA, 474 bp, Homo sapien
cgcgttctttaattctttaagcctagaaagtcctttacactacttacctaaaggtcccaaagtaaaacacacactagtagtaaggctagtgcatttcccttctagcactcaaagaaagcttaacatttttgacagtttgcaaataccgccttgtatttctgattcagccttattcaaagtatcataataaaatatttattaaatstatgttgatctgcgtgcatttatgatctccagattaacgttaggcttctctgttgggccctaacttggaggtgcttttttggatccctcctcccgtgattcattgtaatttcatttcccttgtcatggctctgaccagagaagattctaaatatctgcccccaaagccaaaattatatcttttgaaaagtgaaatgaagagttgagtcastaatttattttagatattactgcctaaaacaattccccaaaatttatggaagttggagg

SEQ ID NO: 158 - DNA, 584 bp, Homo sapien
ttggattctgcagttccacatcattcactccggcaaaggagagaacttgtaacaaagatgagtgccaagtttagtcaatttaccctacctggaatactatatacaactctgggtctcatgtgtgttaaaatacatacagtgaagctgaggaagagccactgaagtaaaaagtattgtttacaagttggaaaggatgtaaaaataatctaaagtatactaagtcaggaataaaaggcagagttaataaaattgtggctggtactgatagacgaaacagatatattttctaaatcctggaataattattaaaaaattttacatgtatcaatggattccagactccatattttaagtttcacaactactgtcatttaaaactataccttattgaacgtctcccactctcaataaattaccccaaatcactcttctccaaaacgtaaatttggaacacactgacttacaaattttgggcttaatttataggatgttgtggccctcaaaaatatcattgtgggctaaacaaaataaattcttgaaacaattctaaaaatcaatcattgtccaaaatgaactttttctaa

SEQ ID NO: 159 - DNA, 671 bp, Homo sapien
cctaattttattacttttcttgccactgctattattgatagaaatacaattaaataattaagatgaaccaatccattggaagattactaaaattgtatcttcccaatgcctcctacagtaagatttctttataattataacccttggagacaatttgaactttatttaaatgttctgctcaaatctaaatttccttctcctaggctgaagcctgatctaaataaggaagtagttgggatatatccacaggctgtcgaacatggagctgcatctgagagacaggtggcagcaaccaaaagcaaagcagggactgagaacaggcaggttccaagagcaaaatggaacttgaaagccaagtatggttcactgtaaaggagaaaatatagaaatacggaactagaacacctggtctgggatgtggtaagcacccaaaatataggaaaactgtatgaattcttgtgaagcagtaaactatgatagtaatcatgtgacacatatgataacaaactcaaaacagggaaaagaggggctttattcaatgctggagataagtgaaaaaaaaagtgaagtgtctcaaggacagaagttatcatctcaaaaaggcatatcagctagatctcgcggaaaccatatgattatcataattctagactctgttcggtattacaaag

SEQ ID NO: 160 - DNA, 315 bp, Homo sapien
ccagagagggagggctctgcttcaccacagggcaccagaagaggactggtgcgcgggaagaccaggtaatcataatgctattaaaaatagcagtaatcatactgttttatacattgtataatgtcataaggattttaactttcatgtaacataattgctgtaaaagtttccccagtttgttttgtgctatttaccctggtgttaaaatgtgtaagaatttacattttaggtatgttaggtttattcctttttatatggtttctgtttgaaattttgattttagaagacattcattctcaaggtcataaaacacac

SEQ ID NO: 161 - DNA, 607 bp, Homo sapien
tttytgtgtcaccttggataattgcttaacttttaaaatttacgttccctcatttccaaaaagggattataactcactgttattttgataattgagataaatgtacgtacaagtgctttgaaactgtaaagtgcattataaacagagggatttaccatagaggttctaccttgatgtatcaagagaagccttttctggaatctggtgcagccttgtgagatgctgttaggtaaggggactccttggtagaatttcttacatttgtgtaaaaagttctggttcctgagtaattccaaagaagatgctatgaggagttcactgtgcctttgatttgatcccaatgggtcagaatatgttttctcattcagtaggctactacaggatttgaagtagaaaaaacagggtccagtgaccttcacgggatcctagatgttcatgaatttcaatcatttgagattgtggggtgtggtccaatgctgctctcaaaaagatgttgcctttcttcasagagcattaataactaaaaaatcccctggtcccaaatttattgtgtgtmtctgaaggctttaactgaagaaatgaaawgcacactcatggaacaaactaa

SEQ ID NO: 162 - DNA, 443 bp, Homo sapien
tgagttttgaaaaagtgaataatcaaaaggaaaataattccttgttgttcataaattaagcatcactaaagtctcttgaaaggcatttctgtattgggcaagatttaaaatactaaagccttaggtcctattcatatttaaagtagcatgtttgtaacctgttactatttggagagagaagcagttgcctgccacaattgaagactacctttcaaatagcaaaagagagagagaaggctgatatttcgggcttttaaataaagatttgtgtggttctgcttttactgtaactgtcactttcccagtgaaaatgatttcatatacatttgagggtcttacasgtatgggtaaagttctataaattgcaacaaaatgatacccaatttcattttatcctttttgtattgtgaaactggaaactttatgacattgtaaattatcag

SEQ ID NO: 163 - DNA, 686 bp, Homo sapien
caggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatcccagaacttggatttagcatatcaggtggtgtcgggggtagaggaaacccattcagacctgatgatgatgtaagttagctttgtatattcttgaaacacctataaagttttatttaccgattgaatacttaaatgtaagtgaaaatctaatagatgtttatgtaaatctaggtagacatcacctggattccccactctattgcttacctttttgttttgtaatttgatcagttcaagttaaaacaatttaaccaaaaactatgaatgtttatgatataatgaaatgattgttaactttcttattgctttttcacacacctataaaagtaattttattactcccaagagaaatcactaaaggcagaattactagaggtaaaaataactagggttggtacagtattactcaggagaagtcaaggggagaaaacttgtcccaatgattcaaaataattttggcatggggggggggagggaaaaaaatttggcttccttt

SEQ ID NO: 164 - DNA, 706 bp, Homo sapien
ttttttttgtttcatttgctgcttaaaataaaaattataaattagatttaaatggagcactaattataaaacagattgcaagtaccaccatttgaaaaaaaaaaaaaaaatcagtggatttccataacacagaaaatgcatggacatgcatctacagtagagttaaaaatttcctgtgactaaaaaattaaaaactggaatcaccagtagcaaatgtatagtcaatggctatgacaagaacagatcctgccgagctcataaatgcaattattggcttttttgctttataaaaaagacattacatattttattgcattattctcctaataaaaaacatactaccacgtagctctccccatccccattctttgcttccagatttttatagaaaataactgttttagtctggccttggaaagtgaacccaccagcaccaccttcacctactcactcttcaattcaatatgcacatagcaaaagccaacacttcaaatctcttgcccacatcaaaaaaagtagtttcaggagaaaaacattaataccagttgaataaaaataagggcataaaagctatgagagagatagctctgccatctgtctctgggctaaaaatcaaggctaactattgcctttggcaccacaaggttcaaggtccatggttttattagaaaagtccccacaaaaaaattaaacccccctcacccca

SEQ ID NO: 165 - DNA, 427 bp, Homo sapien
tyywgggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaamgtctcaggatacaaaatcaatgtacaaaaatcacaagcattcttatacaccaataacagacaaacagagagccaaaatcatgagtgaactcccattcacaactgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatggtgaaaatggaaaaa

SEQ ID NO: 166 - DNA, 124 bp, Homo sapien
accatgttttcgttgtgtgtgagcagggaagggaactttcctgccttatttaaacctgggccgaggattcgtggaatctgcttgatcagagactctgaggccaaaaacgcatcatacttcttgg

SEQ ID NO: 167 - DNA, 232 bp, Homo sapien
tctgcatagcaaatatgatttaagaatttaacatcattatttgatcacaagcgtaaatatgtcaccataaataaatgtaaattcattgtacaaaaattcccaacaactcttaatacaaatatggtacatttgacagtttctgaaacagattatttttaaaactttttaaaacctaagctttatttttttcctggttattagacacacacaaaaaaaataaaaagaggctggg

SEQ ID NO: 168 - DNA, 677 bp, Homo sapien
tttcacaattaaccaacatgcaaaaattctcagactaaacactgagaaattcttcatacaatgcatttgccaccttattgcatttttaaaatctttattctatagtgaattggtattcccaatctgcctaagcaaaggcatgcccttctaacaagatttgcttagagcagaggtgatagaaggaagaatccgaagaccctctggcatggcaatctgggagcagcacattgttgatggagtccaagtgagcacatttcacacaattcatttagtgacaagtgggcttgctcccttttcatccaggaaaaaaactactcacagaccactgcccagaatctggaataagaaccctcattttaaggtattcttcccaacaaataaatatctaaatattgaaagggggcatatcagaaaacttaaaagacacaataaccaaaaccaaaaccctcttcaaaacaagtaagcaatgtctgtatttagttcactctaaaacattcttagcttttcttgcagtttgttcctaaaagatttgattgggcacaagaggaacgaaattattaataaaataaaagcttatttttgtttttgctgtggataatcggtacaaaacgtttccagatctgagacttaaatggatcttttaaggtgaaaaggagaatgccaggttctactgaaat

SEQ ID NO: 169 - DNA, 635 bp, Homo sapien
ttaagaagactgggcatttatactctctcttgctagtcagcctggagcaagcttggagcagacgcacatttttgtactggcacatattcttagacgaccaattatagtttatggagtaaaatattacaagagtttccggggagaaactttaggatatactcggtttcaaggtgtttatctgcctttgttgtgggaacagagtttttgttggaaaagtccgattgctctgggttatacgaggggccacttctctgctttggttgccatggaaaatgatggctatggcaaccgaggtgctggtgctaatctcaataccgatgatgatgtcaccatcacatttttgcctctggttgacagtgaaaggaagctactccatgtgcacttcctttctgctcaggagctaggtaatgaggaacagcaagaaaaactgctcagggagtggctggactgctgtgtgacggaggggggagttctggttgccatgcagaaagagttctcggcgggcgaaatcaccccctggtcactcacatggtacaaaaatggctttgacccgctaccgacagatccggccgggtacatccctgtctgatggagaggaagatgaggatgatgaagatgaatgaaaaaaaaaaaaa

SEQ ID NO: 170 - DNA, 533 bp, Homo sapien
ctgtgatctcacaagtgtgaaaaatcttatgaatgtaaaatgtgtggagattcttctttgtttttagcttccactttgggaacatgtcaaagcacacattgagaagtcccatgagtgaaagagatgttggaaagcccttgaacttggtcgttaggaaacatccacactgaagaggaacctgactgtatggaaggtcaaaaaggctgtattaatttacatgcaaaaagtcacactagaggaatgccatatcagaatgcttttggtaaatatacatgttttaaagaggttatatatcattaataaaaatatctagctggtctgaagaccctgagttatctcaattgttcacggttacagatggaactctttattattgaggagttccactctttcccccatttgtcactactacacttccctagtctttaaaacaattttaggctgggtgcagtggctcattcctgtaatcccagcactttgaaaggccgaagcgagtggatcatttgaggtcaggagttcgagaccagcctgga

SEQ ID NO: 171 - DNA, 568 bp, Homo sapien
cccttgscaaactttcccttaagtattgcactacaagtctaagacacttttcactcaaagttccttccttccttacctctcttttaacttggagtcagactttcatcagtctgacaacttctccctgtctccttccttttccccccttcacaagcatttcacctaacaaatttcttatgtgcttaatcccctcttagaagcagatgccaagatgggattaagcacataagaggtcctggactaatacaatgacaaaggctccccttgaagcatcacactaaaaggaaaaaaaaaaaaaaaacctagccattttacattaactatttctaaaatatagtatttgcttccctatttgctaaaacaaaatatactaaacatgactattccaaaaatctgtagggtactaagaatatgaagagattcactctacttcaggggatggagttgtagtagaaaaggctttgtggagggagggtggtgtttgaaatgtactttaaaagccatcctcaaagcctcgagggctatacctggcctggtgattatccaaggacagtccattcaaacaggg

SEQ ID NO: 172 - DNA, 167 bp, Homo sapien
ccatttacaggaatcagccacttcagttcagacagctttattaaaccgcctggagcgaattttcgaagcatgttttccttccatacttgtccctgatgctgaagaggaagttacttccctgaggcacttgctggaaacaagcactttgccaataaaaacgagagagg

SEQ ID NO: 173 - DNA, 391 bp, Homo sapien
cctcccaaagtgctgggattacaggcatgamccmccmcgccctgatgatagacacgtttttaacttctaaaaatatatgatcatgattgtgtctgtggagacttgcacatatactaaattttaamcaattagagatatttgttcattaccacattttgggagtcattatttcctctatgaagagagaaaggaatttgatacaagttcacaggggcttccagtagattgagacttttatttctagctgagctgctgatgtatgaattttttttgktattatgactttcatatgtattaaaaataaaatgaaaaaacaagggattaggtgaggaacctatacgtctctaatatgcaaaataccacagaaataatgactgktgggaaaattagg

SEQ ID NO: 174 - DNA, 474 bp, Homo sapien
gaactcagagagaggattgtcacccttggcatctgagctgacactataaggacaatgaggagtctccttggggatagatggggagatggaaggacgatgcctgtcctacggggtcttggaaggttagggatacacactgtgagctgccacaggctcaacagtacggatagggggtgctggaaccagccagggctctgatcaccaagctatgtgccccatgcagaggaaggggtagtggcacactgaaccacccagccacaaggctatctccccatacagggcacctttaaaaaaattatccttacaggggaagacggggaggaaggatgaactgtgtgcggtgatgttgcagtgagtgtgagtttgtgtccgtccgcttgtatgagggcctaccttttactaactagcccccaactttcattatctcccctttttctgtctacccttctgcctttttaaagtggcttgcaatcc

SEQ ID NO: 175 - DNA, 655 bp, Homo sapien
ccttgcaggggtggggatgtgtgggcttgttcactgttacagcccatgtatacctgaagggcaacatgtacccacaaatgttccaggaggtaaataaaaaatacaattcagcctcttctaaaccatccttgttgatatctctgctacttccgaaagttaattcgttatttggactccataatttttcctattaattcaccctatgtccaactccaacagtgaaaaaaatttatttaatctttgcaataagcctataggcaggcagcattatcctcagtctgcagataagctaaggctcagagaagcttgtatactgtcacttaggtagtaattgcaagagctggcattcagacccagactgtgggactcctcactccattctctttccccccactaggctgctccttaaaatacaatggatgcttgatgaacgcttgtgggaatcctgggtggacacagttccttttcggccaaaagcaccttgacgacttgtgaagaattaatctggaaaacttaacctatttataaaaacgtgttattaagggcaggttattcccaccccctttaccaaagaaacccgccctgacctttttttactgggggttggtcttgggcattttcaacaaggggggaacagtttaaaaattcccccctt

SEQ ID NO: 176 - DNA, 660 bp, Homo sapien
cctggtcaaagtgggcattaccattcaagcattactagacatcaccgtaacgaaggctctgttcacatgaaactaccccttctccattgggggctcagactctgctctcatccaggatcctgaactctgctccaggcacctgttcaaccctctctcccacccactgcctgtcacttcactgactccagttacattgaaacaattttcagtctaagggaggattttctacctttcagagctgacctccgactttaagacttgacaggtatttatcttgaaaccagagagggagctggaggaaaaaaaaactgagcaagcacatcaatgccttttccacccttcttcatcctttccacactcaccgactgccattaccaaaacgccaagcacaaccggtttggaacaagacgcattccgttttaattaaaaccaactcattatgtattttagtgggggggaaggggggcacaatcagggttttcaccaccaaattttccacacggtttctgaacaccattgccttttaaaaaactatttttccacctccaaaatatttatttaaattttatttattacggaggtggtattcttcctttgggagccaaattgggaaatttagggaaccttttttattacccggttttttgggcgggtaaaccc

SEQ ID NO: 177 - DNA, 459 bp, Homo sapien
ctttttctcttcctctgtggaatggtgaaagagagatgccgtgktttgaagagtaagatgatgaaatgawtttttaattcaagaamcattcagaamcataggaattaaaacttagagaaatgatctaatttccctgttcacacaaactttactctttaatctgatgattggatattttattttagtgaaacatcatcttgttagctaactttaaaaaatggatgtagaatgattaaaggttggtatgatttttttttaatgtatcagyttgaacctagaatattgaattaaaatgctgkctcagtattttaaaagcaaaaaagggaatggaggaaaattgcatcttagaccatttttatatgcagtgtacaatttgctgggctagaaatgagataaagattatttatttttgktcatgycttgkacttttctattaaaatcattttacgaaaaaaaaaa

SEQ ID NO: 178 - DNA, 720 bp, Homo sapien
ctgcaagctcccactccttccatttatcttaacgcccaggctgacttctaagctgcttttcactttcctacctccactgcattttcgcccctgataatttttgtaagcttacctaagcctcccttcttttgagatccccttcttaaaagggtccattctattaaccctaccccatatccagttacttttactacctgctgatctatcgctaccttgtccaattcatgggaattacagggtgcactgggacaagagtaaaatgatccaacaaacataatgttgcatttaaaaaaataagctaaaagatactgatgactttttataactacaacatattcgtttgtgaataagaacatatatagtaaaaagatgaaaatgtgaacaggttgactatttcctaaatttatggcagaaggttgttctggagaggatgggaagaaaaaatgaaggctggcagtgatgggtggggaaatgcaacctccaaaattatctatctatatatttttattaaaaacacccacagtaattatggcaaatgttaatggtttgtttgttctaaggttttggatacatttaagatctcttgctttctgggtaccatttcttttcttttcttttctttttttttcaaattaattccaaaagacttatatctgctacatgaagaacgaagcaagttcagctctcttggctgaaatgttcaaatgcttgagggcaagg

SEQ ID NO: 179 - DNA, 427 bp, Homo sapien
ctgtgaatctgtctggttctgaacttattttttagttattggcaatctttgtattactatttcaatctcttcctggtttaatctaggagggttgtatatttccaggaatttatccatctcttgtaagttttctagtttatgcacataaacgtgttcatagtagccttgaataatcttttgtatttctgtgatatcagttgtaatatctcccatttcatttctaattgagcttatttgaaacttctctcttcttggttaatcttgctaatggtctatcagttttatttatcttttcaaagaaccagctttttgtttcatttatcttttgtattgtttttgtttgtctcaatttcatttagttctgctctgatcttcgttatttcttttcttctcctgggtttgggtttagattgttcttggtttctct

SEQ ID NO: 180 - DNA, 728 bp, Homo sapien
caaacacaaaagtcactgtgtgtgtgatgcttctccaattccactcatcctggctgccattcatgcactagtgcatgtatgcatttttacattttttaaattacaaaaatcaacctattataactgcttagatatatatgaagtaaaaatgaaagttctccctttacatgacccatcccccatcatttccctctttatcttatactgtcagcattcccagcttgtagcacagtgtctggcaatagtaaatcctcaaaaaatgatcaatgaataatttaataatgattaataaataaattaatgatgatggtgaagataaattttagcatttattgaacgctaactacaaaccagggagtgtggtaaatattttataaaaatcaatgaatgagctaaaatgccattctattatttttttggatacggtttaatattttactcataaatatgcttaaagaatattataattatatgacttagaatggtaaaacaatatgtacagcagtatcctattttttagaataaaaatataaatatgtgctcacatatgtggttggggcatgcctagaaacccgattagaacgggattttttcttaccaccattttttttacctgggaaaaatatgggaaaattttatttcccttctttttggttctaaaatttatatacaggagcctatttggctttggataaatcattttaaaaaaggtggtttaaaaaaaaaaa

SEQ ID NO: 181 - DNA, 546 bp, Homo sapien
acaatcctttggaagacactactgggctttgggtgctgctttttaataattgagttattttgagcttgccaagtaggatctattgcctggactaaaatttatttcctaatcttctgatgaccaagaaaggaaaaattaagtttgcagatgggagatgaaatatagccagcgaatatgcatactggttctgaatgaaaggaattaacttttcagtcaagaaacagtctgcatgccgtaaattgaatttttcctgcaactggaatgattggttaattctttttgaacactggcctttctccccaagaacactaatgaattgctaatattttttaaagaaaactggttttttaattaggtaagctccacttcctcttattttttaatccctaaagaaaactgttaaaagggaatggatctatcacgccttttcttttaaaaccacctttttaaaaaaggatttttccaacccccaatttgctcttattttaaaattttgaacgccaaaagaagggaaataaaaatttttcccttaattttaccccctta

SEQ ID NO: 182 - DNA, 333 bp, Homo sapien
ggccactctgactgggtctgctaattcacatgctctttgtgacatacggctctaagaggcagaggctggaagagaagtatgtgggttgtgggatcaagatacccaagtttcagtcttgacactgctattacttagtcaggtgaccactgtaacttcatcttgattgagcctcagatgtctcacctgcaaaatggagtttgaaatttgctatggttgggtgtcacacggattaaatgaaataatgcctgttaagcgcctatccagcacttaataagatggccactgcatcataatgctttgggcacaagtaacacaacatccaacccaaagggg

SEQ ID NO: 183 - DNA, 393 bp, Homo sapien
ctgaatttcttgggctttatgtggcagtgtggtaaaaatatatgatcagatttcactgttaagaaaattctttcagcaatacatgtagagtcaagtttcttgcatggataactgaacatgtgggttatgagattttaaaaaatgtctcgtgacaaactttacggaaatgcaacaatctggacatctagttttgtctgagagtggcgtggatatgaagaactgtgctgttggtgctgatgccacactaagttttggcagtcacactcttggttcttcatatttgaggagatgggatggtgaggaggcctgttggctttattttattacgtgccaccatctagaatacagattcttggatatttcatcttcacaaaggtgaagctgcaaactcag

SEQ ID NO: 184 - DNA, 700 bp, Homo sapien
  misc_feature (1)...(700): n = A,T,C or G
ccaggscawtgaggaaaagrgaaagaatwtarrggstwttcaaataggaaaaraggaagtccaaattggtcccntgttkgccagataaccatgattgkgkatttagaaamccccatgwtytcagcccaaaatctccttaagctgattaagcamcttcagtaaaktctcaggataaaaaatcaatgtgcaaaawtcacaagcrttcctatmcgamcaatamcagmcaaacagagccaawtcatgagtgractcttattcacaattgctagtaagagaagaaaatmcctaggaatacaacttmcaagggatgtgaaggwtctcttcaaagaagaactacaarccrctgctcaaggaaataagagaggmcmcaagtaaatgggaaaagcattctatgctcatggataggaagaatcaatcccgtgaaaatggkgatactgcccaaaataatttatagattcaatgctatccccatcaagctaccattgactttcttcmcggaattnggaaaaatctactttacacttyatagggraccaaaaaagaagcccwtgtagccaagacaatcctaggcaaaaaagaccaamcctggaggcatcacagtmcytgacttcmaactatwctaccaaggnytmcrgkgmccaaaacagcacggkacntggtmccaaaccrgacwtwtwgaccmmcagacacagaacmgagg

SEQ ID NO: 185 - DNA, 192 bp, Homo sapien
ccagyctttcttttaagtaagcgctttttcaagctcattgtagctacaaagtcaataaattggtctttgttatttttacctgaaaaggctgttaaaggttaaaatgacaaactcaaattcaaagggattggaggatttggtgtttatgatttctcagaacaacaatctagagaccaccagggtgggtttcag

SEQ ID NO: 186 - DNA, 688 bp, Homo sapien
gtgctggaattcgcccttagcgtggtcgcggccgaggtgggatatttcttctggatagatttcagataggtagttccctcaaataagattatatgggtttgcattttcaaggcagagttgtatacttcctgctctttatttaaataaaaaaacttgaaaatctgttctgcccagtattgtaagcgctcaggtacaaatatgaatgaaacaatctctgcctaagtaacacaagtatagggacaagattctcagtaaaattctcacgtgaaatttgtaactcactagacactatcaggagatcaataattatgtaattaaaaaaaataattacctgccaaactgggttcttctttggcacttctgcttggttttaagacaattctcacatagaagcttattattccccattagtcattccatagatgtaaaactggtagaaacaggacttgaattgaacattctttacaagtaagttatatagcttctgaaaaaagggcttgaaaaagcatttttggggactataagaaccttcaaatgctttcccctcttaacaaaccttaaaattattttgaaaataatttaagggggctgattttctcttgtcaaaatcttgaaccccacttaccaggtggttggtcaaaccaaagttcaaaaaaaagcttctggcctttcctttatcccacttgca

SEQ ID NO: 187 - DNA, 779 bp, Homo sapien
gcaaaaaacagatacattttcagtgtttaaaaatgaacaagtatggaaaggcttatacagtaactgaaaagtctcctttgggaagccaaggtgggaggattgcttgaggtcaggagttcaagaccagcccaagcaacatggcgagaccccatctctacaaaaaattaaaaaatcagccaggcatggcggacatacttgtagtagtaactacatgggaggctgaggcgggaggatcacttgagtccgagagtttgaggctgcagtgagccgcaacgcgccctgtactccagcctgggcaacagagcaagatgctgctctaaaagaaattttcttttaaagaaaaaagtctccctcatagcctgttctacaaaagtcctatttcttcccacaaaaagcctctggtacctggtgttagttcttggggtggaagattacttttaaaaatagaactattttttaagtatatcttttagggaactttagttcccgaagctttaggaaatgggatcttgaaaacaaaagggatttcaatacctatgacaatgcttaaagaattattggggcatttatttttcaatggagggtccacaaatctttggaaacccttggccaattaccagaagccactttaatttttgaccgaaaatgtttttaaaaattggcttttggaaaaactgtctctttccccaaaaatgaaaaccttgaaaaaaaggggaatttttaaggttgccccctcattaaattttaacccctctgaaagaaaaccctcttgtgacagg

SEQ ID NO: 188 - DNA, 394 bp, Homo sapien
  misc_feature (1)...(394): n = A,T,C or G
ggcgamgtctggycaccatcatgccctttaatcaactcacacctgtttaaagagtgtttctgatttgaccttcatcccttagtttactggcgttaaaaaaagtctcagcaattttcattatttctcgtgggtctcattatcaaacctttacttatttcggcatatttcctctgggcttcttctagtttctgccttacaagcaatgctgttctgtaaatttattgaaacctctggaacatttcacctttagagatggaggatggaaggattggyaccagaagagggctaagatacgttytctgtcttngagctgaaagcacagyctactctccttcgttttgycgatgagaaaagttgaggccagaagggaggtgacatgtttagagtcacccag

SEQ ID NO: 189 - DNA, 681 bp, Homo sapien
aagttctgactttggtctataaaacagggttattggctgtggctgcactcaatatctaaaaagttattaggaagtgcctcgttattgtcattaaagatatctaaatatggtagaccaaaggttgttgagaaacacatattatggactgagttctgtttcttctgctgtggcgcacctaagctcaagccttccttctctccctccccttctggccggcatggtatctgagctcacagacagacaaggcatgttagaatcatcagatcatgagcaccgtgctgggatttagccctctccaaagtcaattcttacagtccatactttgcttaaatcctcagttgttgaggtctgctctgctgtcagtaatcccagctataaatttcccccaaatgtggggcctagataaagtagaaggtggatggactcagcttattttcatgggatgacaggaactggaaagagaaagggcattgaaaataaaaagttattccagaatagcattaaccctcttactgttcaagaattaagaaagcctacttagaaatgagggccttgagaatgatacccaaatattggtctttctaccaaaaaatggcctttccaaatatctgctttcctgttccccaattggctttttaagtagaattaagttacctaaaactttacctgaagggtggtttt

SEQ ID NO: 190 - DNA, 839 bp, Homo sapien
caaatacatgatttccattggcatagactcttctatagtctctcaggcacaccttatgactaataagaacactgtcttctagatataagccaagttttaggagttatctttgtagtttctgtgttgagactatgggtcttccctgtgcaaagacttgattagcaaatactatttgaaacgatcccaaattcatagtgcagttgaccacccttctgatcaaggggatctctgtatatcccatgaaagcttcataggtctcaccctagattaagtgcttcacttctcaagacagtgaacagatggaagacttttgtagttatcattatacaactgtgccctgtgtgttttattatacaaccagagaactgaggcactggctttacctgtcagctacgccaggggtgtgacgtcatctttctgacttgatcacacatgccacattgcttaatatttcaagcttagactgaaataatcctgtggtaaaaaatttttggggggctggggaggtaaagaacaagggggggaactttggaatatttttattcattaatcatatttcccgaattgtattttattttgaaatgaccataagggacttaaatacgtattgtggttaaattaaatggacccaaatggaggtaagtaaacctaatgggacaaatgaataaaaggtttatgactgggagcatttacccatgaacctccttagaagctatttaacctttcttttggaaagccctgaaggctgggaacttaaattttaaagacagtacctatttccagaatcgcttccaaatggccatgttttaaagggccaacattttgggatggccctgccc

SEQ ID NO: 191 - DNA, 697 bp, Homo sapien
ccatcctgaatactgattttctaatggaactctattcaatggcgattgtaaaaccctgaggctccgttactattatggagcatactttcatctcattctcggctattgggcaatatgtatctcataagattttatcacatttcacagatgaactgttaattgattccatgggtacgattaggcgagatccaagctggagctgcagctctgagtcccataaattctttgtgcttctgtaaagaataaatctgtttttaatgcaaattaaaactactggcagggaattttggctcccagttattaaaagactggaaatgtgtaagtggagaaaggcaataactgcagtaatctcttaccggactctattataattccaaacatacataatggtgagaaaaaccgggaagggaagaatgtggcaatgtccactctttgccccaaacataacccttaatttccatggcgggcccaaacactggtaaaaaccaaaatggtaccctctatagcatgcaacttttatttcactccaaacgaaaaattattttgactatggcttgggaaatccattagtagaagaagttttataacctataggaacccggccatttcatttctaccaaatcacaggaattttagaatgggcaaggaatttacaggaagacttgcccaattatctttttttgggggactaaaccaa

SEQ ID NO: 192 - DNA, 687 bp, Homo sapien
ctggttactatagctttgtagtataatttaaagtcaggtaatgtgattcttccagttttgttatttctgcttaggatagctttggctattctggatcgtttgtggttccatataaattttaggatagttttttgctatttctgtgaagagtgtcattggtactttgatagggattgcattgaatctgaagattgctttgggtagtatgaacattttaacaatattgattcttccgattaatgaacatggaatgtttttcctttatttggcgctctctttaatttccttcatcagtggtttataggtttcattatagagatctttccttcttttgggtaattcctacgtatttaatttatgtatcgctattgctaaatggaatgactttttaaatttctttttcacattgctcctggtggcatattaaaagctactgatggatggtgattttggattctgccactttactggaattggtggatcagttctaatcgttttcttatgcacccctttacggtttctacatgtaagaatatatcaccttcaaacacggataatttgacttcttccccatccaattgggaggccctttatatcttctcttggcctgaaggctctacttaaaacttcttatccctttgttggaataacagtggggacaaatggacatcccttgtcatggtccca

SEQ ID NO: 193 - DNA, 493 bp, Homo sapien
ctgctaaaatgatgttgctaaagcattcctttttcttttgattaaacttcatgtttacaaaaaaattaattctagcagaataacgaatggttttgttttctagttctctgctgaatgaacagttttgccaattatcttcatagagtagtgatataatgaatgcaacctcaaatgcaaaccaaccaattcacagtccataccccaatcacttccttcatcagcctcaaaaatcgctaagtgaaccagtagaatggttttggagcagtaataggaaagcaaatagaaagtcaagggggactttcaacgccaacaagaccaattcagatcctgatctgactggtttctaatacaatctctttccagagtaatggagcatgagtctgccacacagaactttagagagagtcctttatttcaaagactgtaaagttggaagaattcattcatctgcaaagtcaaatgtcaaaagttgtgcttcccactcctcatcagg

SEQ ID NO: 194 - DNA, 424 bp, Homo sapien
  misc_feature (1)...(424): n = A,T,C or G
cyagggcanttnagcangasaaggaaatanmggggattcaattagggaacwraggakarwcaagttgtccstgtmtgcagatgmsgtgattgtatatctagamcaccccattgtctcagcccaaaatctccytaagttgataagcawcttcagcarmgtctcasgatscracmtcwatnsgcraaantcacmwgcattcttatacaccaatawcagacaaacagagagccaaatcatgagtgaactcccattcacaattgctacnmaagagaataaaatacctaggaatccaacatacaagggatgtgaaggacctcttcaaggagaactacmaaccactgctcaaggaaataaaagaggatmcaamcaaatggaagaacattccatgctcatgggtaggaagaatcaatatccgkgaaaatgg

SEQ ID NO: 195 - DNA, 229 bp, Homo sapien
  misc_feature (1)...(229): n = A,T,C or G
tgaacacccttnggaaggaacctgctcgnatgtannanaaanggaccggacagtctgctaaaatcgccctctttagacgcggcgcgccggggcagagtttttctctggtgctttgacctgtatttggtttaatggttttgtcctaatctcttcaatcaataaaattgtgcgtatttaactaaaaaaaaaaaaaaaaaaaaaaaaaaaaaaaaaaaaaaaaaaaaaaaaa

SEQ ID NO: 196 - DNA, 557 bp, Homo sapien
gcggtggctcatgcctgtaatcccaccactttgggaggctgaggtgggcagatcacttcaagttgagagtttgagaccagcctgggcaacataacaaagtgagatcttatctctacaaaaaaattaaacaaacaaaaaaacaaatcaacattcatttgcagggctctttggtcttcttaaagaacaaacatatgaaataaataagctgattcttaaagataacaaatataatgagctttctcaactgtaaaagcatctctaagttgttctatcaatgcatatccactccatgaactaacctgaagaaagtgttgaccattctacccaattaactgtaaactaagattgctttaatggtttgcctaaatttgagtacctttaaatttttgctttttatccaaattcattctcccttcttcaaattaaatagttttgttagaaatcggataagcaagatgtactttttagaaagggcaatagaatcctacaacatgctagaatttgaaatgtttttttaaatcagtmmtttctctatgctagtaactaagaaaattata

SEQ ID NO: 197 - DNA, 624 bp, Homo sapien
ttttactacctatatttaaaatgatccctgacgcccctcaagacaaatatattaatttttttactttgtgggatagagatcagaaaaagagtagagatgaaaatactggagaaacaatgcaggagatatttatgaggtgagaatgtcaagaaacttgtaaagggagaatactataatgacccctgaagagagagctttagaccagttgagtattagaggttgccacgtggctattcatccactaataaatacaagaaattactaaaatggaagccactggaaatatgttttgaggaaggtgagaatgtggacctattataaatgggtgaatatgatttctttctcattaagttcataaataactttcagacatgtaacagtttatgaagtgtgccgtagtcatttagtataagttttatacacaaaagtgtttttactaagactgtcacaggttcttttgtgaatcttgtttgtttttcctcattgtaaatactgcaatagaacatttgtgtcttaacataaggcaataaatgaccttaagaaccttcacttttatatagaaagtggaggaaaagttggcagagtaatttgttgattatagataaaagctcttgtagaaattgg

SEQ ID NO: 198 - DNA, 175 bp, Homo sapien
ttttttttttttttttttttctaacacttatgcatttattttcatgtgtaagaagaaaaacgtaactagcacgtgaacatgactgcatggatacacggctcagcacgaggctaaagtcagaagtgagtgaaagcaaaaccgcatgttgatttaagtgaaataacagaacagaaaa

SEQ ID NO: 199 - DNA, 871 bp, Homo sapien
ctgttgatcaatgatgagctcccaagagtaaccagcctctatatagtcagcatcactggtttctcaggaaaagcatcaccattgttcatcttgctgcaaaatgtatgcacaagtatctttttatttttaaaaaagccctgacattttatgactgctgcttttctaagatattttcaaatatacagtccatacggttcagacacaatggactggggatagagacggctatagtgccgataatggagaaactagccagagcttcagatatttgttttccaggacatctcaataattgggtacacctcacaatatgtgagacttgacgtcgagtggcacggcatactctggcgcaggcacttgataaagactgtgtttgcaaatacttagcctgcacttcaagataccaggcatctaagcacgtcccagatggtgacagttaatcttcaaaaaaccctatgtggaagtattatcattgtcctcattttacagatgaggaaaaagagacacagggatgtcaatatcttcctcaaggtcacacagcaagtaagtgatggaacagtggctcagccatgaagctattgctgttaaccactaggttgatttgccttcattaatttcttcctaaaactgcacatttcccgttagtccctctttttggtctgtcgtttgactcttggctactgcttagaggaagattcattctattattttctaacttagtaaatatgtgcaactccttggggacatgaccaggcaaaagctggatacagaaatgtatgcccaaacaccatcccaagttacccctaacaggtcttttctggaccctgtttgtaaggggggtatatttggaaaaatttttaaaattttctgg

SEQ ID NO: 200 - DNA, 737 bp, Homo sapien
gacattttgaaggtaacagcaatatctgtgtatagatggggttgtggttttgttatttatctgctattgctgaactatcctttgtcttgagcgataaaagagaagtaaaatactaaagaactgaactgtccatttctggaccatgagtaaagatgctggctgtcaaacttcctgttcatacattagtttatttatagagtgtactctctatgtaaggtattgactgataatgttactttgacttcagatagcttgcagtttaatggaggaagaagacaaacatgcaaataactaggtcaatgaggcatcctttgtgttccattggaagctaggctgctttgtaaccttgttaatttctgtggttttggagtgcattcattagcaaatacaccccttgttcttatccattctctgcttttttctttatttggcatttgatgacattttttcatgtggggaaattgagtcaggtgaggtggaaagaaaataaggacacgacactaaattctttgatgtttttccttaaaaaattgtttttcaagtgctccataaagggttgtgaagttttaagagccataggacttggattattgtgaaagagtgtctctagggggccaggttaaaccatttcaaggactctccttctctcatctcccttgttccacccagggtggcgacccccaaaaagcacaaagcctccctttcttcatgggaagggtaaggaacggaagggaacc

SEQ ID NO: 201 - DNA, 493 bp, Homo sapien
tctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataacacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacatgaacattattttgctttaaaaactataaacattgtaggagaattatagccagtcttcagttataaccactccaccctcctcactttctctctctctctctcttttttttttgctatgggatttaatgggaaaaatatgtaaaaactgtcactaa

SEQ ID NO: 202 - DNA, 283 bp, Homo sapien
cctttttatctcagtgacaccgtccggggacgcaggtggtggtgactcaaggctagcctcaaagggcagccccacctcctcatcctggaccacagagaccacctgcttggcgcgccgtcgcttttccgagagggtggctgactccggggtgctggggctggggctgccgcccccgccgctgttgctgtactcctcgccccagtcgatgggggctgccctcggacagcaggtgcaggttgggggcactgttacgcaagaccatgctgcccggagaggtagatct

SEQ ID NO: 203 - DNA, 713 bp, Homo sapien
ctgcttttgcgcaaggtgccactggacgagcgcatcgtcttctcggggaacctcttccagcaccaggaggacagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggaatccctgaggactccaaggtagagggccctgcgttcacagatgccatccgcatgtaccgacagtccaaggagctgtacggcacctgggagatgctgtgtgggaacgaggtgcagatcctgagcaacctggtgatggaggagctgggccctgagctgaaggcagagctcggcccgcggctgaaggggaaacccgcaggagcggcaccgcaggtggatccagatcttcggacgccgtgtaccacatggtgtacgagcaggccaaaggcgcgccttcgaaggagggggctgtccaa

SEQ ID NO: 204 - DNA, 275 bp, Homo sapien
gtagacaagtacagcagatccagacaccagatctagctaggctaaatgtacagtatctaacttgatctgaactgaacctgtattccttgatgatgcctaaaactacatccatagaattctggtgaacctgtaatacagttctgaaagtacagttttatataataagatgctgatctctttattctttcaagtaagagtgctagagaacaaattgtgttacttgccttgggatttattgaacgtctggaaaatgctgtcttcctagatccaaacag

SEQ ID NO: 205 - DNA, 694 bp, Homo sapien
ctgttcctgtacatttaactgaaaaaaaagtaacttaaaataatataaaaatagcactcatgtatgtcctacagttataggtgaaatttgatattgtttgtcttacatagcatacctatagacagcttaagtaaagtgactgttaagagggttatgcttattgatgaactcttgtagttgcttaccagctctgttagtatagttaaattgatctcagtagcttcaagtatttataaaatggttgaagtccaaatacatgtgataattacaatacactttgaattaatggagggtgggaggctagttgaaatgcattttatttacccaaggagtatgttaaaatgatagttataaatgttggaagtttaaagcaagatactcagtttagttctttacaaatcataagaagaacaaaattagatgttgacattgctattttaggctgtgtgttttccatatgcttcttgctttccctgtcacaggtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtaccgtacacaggtgctgggtcgatggccactttctgcttttctttc

SEQ ID NO: 206 - DNA, 704 bp, Homo sapien
  misc_feature (1)...(704): n = A,T,C or G
tttttttttggnaaaaacagggtttcatcatgtttgccaggctagtctcaaactgctgacctcaggggatttgcccgcctcacccaattcaactttcgtaagtcagtatttaccatctaactcagtgtcccaaaatttaaaatttccttgcactttacagcaaaaatacatattggggctctactgaagcaatatatacatgtcaaaactaaaaatcagaaaagcaaaagggtccattcaacatatagcagcttatatttaaatatgtacaggtatgtatgttttcacagttagatctttaaaaaaatttatatttgatatgttcaaaaatacttctattggctataaataatattttaaaagctcaactgatcaaaatgcattccaagaacatatcaaattaaataaatcttctacgtctttaaaaacagataattgaagtcagtaaagcttgaggtttgtgttaagtgtattctgtcagtccctactactagggaaggcagaatcttctaaatacgatacgaaagaaactcccaaagcttggaaggaatcggcagctcctgaactttttggggggggcatccctcttcgggattgacatgcgacataaatgttgcaagctaagggaccccccccgggggagtgggccccaaaaaaaaccacaccttccccgtcaatggtggtccccccaccaaccttaaaaa

SEQ ID NO: 207 - DNA, 225 bp, Homo sapien
ccattttaactgtactgccaatagaattctggaattgtggaaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggca

SEQ ID NO: 208 - DNA, 678 bp, Homo sapien
  misc_feature (1)...(678): n = A,T,C or G
cctatatctatcaaaaaaaatccagttcctaactaataatctcccaaaaagaaagcaccaggaccagatgatataaatggcaaattttttcaatcatttaaggacaaaataataccaattctgtatcatttcttccagaacacttcctaactcatcgtatgaggccagcatcactctaatagcaaaaccagataaagccattacaagagagagtgacagaccaatgtggttttattgaggatgcaaacaaaatttaacataatatttaatagtgaaaaactggatgctctttccctaagttagagattaaggaaagaatgtccccttcactactcccatacaacaccttactgaaaattctagctagctttataaaataaanaaaaaccanaaaataaaataaaaggtgtacagactggaagatacagtgaaggaggaagaaataaaattttctttgcgcataacatgattcttctatgtggaaatcacagagatttgaacattttttttttttgagacagtttttgctcttgttgcccaggttggagtgtaatggcgcgatctcggctcactgcaaccttcacctcccgaattcaaggtgattctcctgccctcagccttcccggagtaagcttggggattaacagggcatggcaccccccatgcccccagctaaat

SEQ ID NO: 209 - DNA, 720 bp, Homo sapien
  misc_feature (1)...(720): n = A,T,C or G
attattttgaaccctagcatttagaaatgaaaaactttttataacaatcaaatacatgataaagtatgcaaagagtaggaaattattctgatgacatatggagggttacaaaggagaaaactttttgctacctctgataaagaatagactaaattctccaagaccaatctgactggtgtcataataaaaggaggtacacacggaagcacaagggatgtgtgcctctggaggaaaggtcaggtgaggactcagtgagaagacaagccaaggagccaggtcttggaagaagtcaaccctgttgacaccttgatcttggactaaccctgtggacaccttgatcttggacttttagcttccagaactgcnagaaaataaatttttcttgtttaagccacccanagtgtantgttttgttatggcagccctaacaaattaaaattatattttaacagagaatataaaattctaatataacattttacagtaaagcattcatggtcttttttttcttattaataaatccatcaaaacagaaagttttgcaaaattttaacacatttctctaccactactgtttctactctcttaaaactactccgcaaatataaaaatagaaggccaaaatgcatcattaaaacgatgtttggggactaatggccttaaaattctattacacttggaaatatacaaatattcaaagattatctattgatcacctca

SEQ ID NO: 210 - DNA, 277 bp, Homo sapien
tccatgtatttttatacagaatggaacaatatgtatgtatgcaatykttacattccaccatgaaataaaacagtataatgaaaataacaatagattcaaacaatgatatgctatttttttttacctatgacattggcaaggtcttcttaaaaaatctgcgaataaccgatgttggagagatcatggggaaatagccactcaaatgttactcatgagagtgtacatatgtgtaacttcacttggagggcaatttggtgatacatttaaaaagttttgg

SEQ ID NO: 211 - DNA, 715 bp, Homo sapien
gtggtagaaatactaattttgcaattacagaaaaaaacaaatgccattcacatggttyctaacaaaaagtgtctgaccacccccaccccccacccctcaaaaagcccttaaataaagaggaagatcaaaagaaaacaaaataattcccgagtttcacctcatacatacaatatagcacaggaagtggcaaagtttaaaataatgcctttactgttaggactagtatgctgtcaaaagccacaatccttttgttttagtgagttgattttcaatagaaaaatacaaatgaacatgtgtttaagttccaacatggattgagcacctctgaatttagtatcaaatgattaattttatttttcagatgtcaaatcttagtataaaattttccattattttaaacttcacttgaatctttaaaaaagctgtctaaattgtactatatgagttcagtttaatcttctgtaaaatgctaacaaattgaactgtcagcagtcttttaaaaaaaaatgggggctgggttatttctagaagaactctcattaagctttgaaaatcagaaatcagagacaaataacttcagatatagactagctccacaagcaaatttatacaattatctgtaacagtctatacatatatgtgtatatatatataccgtaaccactttcataggtaaaaaatattaacttcatgtcacactatgatcagaagtata

SEQ ID NO: 212 - DNA, 717 bp, Homo sapien
agcctcccccaatgccttaaaaggtcacagtagatctcagctctgaacagaaactcaactgaaactcttcccacaacccagcagtagatatattaaaacctacaattttcagggatacaaccaatatttaattcttttgagggttttgtgtttaatacaaggacacaaacacacgtataaaatgacgatgtcaatactgattaaacagaacaacaaaataagaagctcaaattatcatcagctattgtgtatatctgaaataacaataatgcacttgattctgaaagaatgattagagttcctactctgaaaatctaattgtcttgatgtggcgaagtgagaagaaaggatgatttttctaatgaaaagcatgtatacgggtagccctttgcgagattctgtcaaaaccctgaattttgcattagctgttttaccacccaaacgtttttacccgaggatgtgcagcaatgggaactctcatacactgcttgtgggaatataaatcagtataaccactttggaaaaccatttaacattgtcaactacagctctacacacaagtgctataaccacccattccactccagggtatacaccctaaaaatatgaagtgcccatgtctacccaaaaggccgcctaaaaggaatgcttttgagaagggttaaccttgttaattagtggcaaaactgggaaaacaacccccaaatggtcccatcc

SEQ ID NO: 213 - DNA, 599 bp, Homo sapien
cctgttttggcgaggcaggagggaagcgggatgggagtggtggttaggccaagggtagttcaaagcgattcagcaggatgatgaccacaggagtgctggagccgggcctttcagcccccgtgtggatgatgaccggccatccaggacatgcgagggcttgggacagtggacagccagtgccacacaaggaaggaccgattaaatgacacagttaaaggaatttggcctagggagtgcaagccagaaaggtttggtctttttatatatgtaacattggaaaaaaggaacatctcctgttccctgtattaagttttgactttagctcagcaaatgcagtgtttgtggcagtaaatatactctgataacaatgttctttcccaggaatttagagttttatgatggttattgaaaatgtttacatgacaggctgtcaataatattttttgcctctaaaaataaaacatacataaagtgtacggattttaagtatgcaactcactgaacttttcataccgtaatacaccaccctagtaaccctcccccagttcaagatgtagactgtttccaataacccctcatcctgttccttaatagccccc

SEQ ID NO: 214 - DNA, 789 bp, Homo sapien
ccttatgacaaaccttgctatgccaaggatatgcttcactatcttcatctatcaaaacactatgcatcatagatatctaattttttcatctcttgcatgaagtctttcctgatttccctctgctgaaatttctctcttcaaatgatgtgtttccatagtactttgtcccttttcaaagatatatctcacatcgcatattttaccacagttagtttcatttcttaactctcacactagattacaaagtcaatatagacaaagaaatgttcaaccttatataacctcctctgcctatgctggtaaattgcacctactatgtgttcaataagagcttgtctttttcaatatacaaaactttgtaaagattaaagaccttgtagaaagtcaagaggaagatagcaatttcacttctaagaacttaccctaaggaaacattcatgaagagatacaaggggttatgtgcatggatgttcattatcatattattcttcattatgaagattatgatggtaataatgaaaatgattatcttgtattgggccttatttgaagtcaagcattgagaatgtactttatctgcattatctcactgagttctcgtagcagccctataaggtacagactgttatctaagcttaaaaaaataaagttaatgtccaaggtcaaacaactagtaaaagaagggggctaggaaatttggaaccccaaaaggggcaacctctcaagggctatgaatccttaccattattataaggaagcttggcccatggtggcccaaaaaaaaccggg

SEQ ID NO: 215 - DNA, 765 bp, Homo sapien
ggatgtctgagcaggagagagaccatgtgaaggatggactgaatggagacttgtatcaaagagtctgagtatcaaagacttgtattagagagggttgttgtagtaatctagtcagggtatgagaaatggtttgtattagagtgtcaggagtagtcgtggcaaaaatatatagatcaggatgagggatgggcctcatctcacaccctgactccagtcaatggcagtggctccctggagtacactactataggaaggattttgtaaagttttgtctggcctcagtggagggtgaggtaggggaggagttctatgaacagttagtggtgtctgccatggttgaaacaatggagaagggggacaccttttctgtgcagatgttgcttctggtagatataatccacaatgtaatgggagaagtactaagaatcagtaaattatggagggtgtaaaagactactgatatttaagcctgcggaccggacttagagaaatgatagttaaaggagaaatatccagcaaacaaagatatgacattgaagtttgggactgcgattagtaccagagatttggattggaggtgatttgtatagaatggataggtgattttactcttgcaatttggattgaggggtggggaaaaccagaaaggggctggggggtaaattagtagaaggtcaccttgaattcattgtggtccatatcaatgctgaaactgattggggaactttttactcttgagtccctttgtaagggaaccccagaaag

SEQ ID NO: 216 - DNA, 780 bp, Homo sapien
cctttttctgtggcaaatggaggcttttcactgcctgtagagacaatacagtaagcatagttaaggggtgggtcagaacatgttaagataacttactgtatatgtattcccttgtattttgttaaagctggaacatttgatatttttccatttatttatgaaaaaatatgaacctattttcatttgtacaaggtaattgttttttaaagcaagtcaccttagggtggctttaattgtataagtcaagcacatgtaataaattcaaaacctgcagttaacaggatattagacatcaatcctggtaaccaaatattaaagattctctttaaaaaagactgaacatgtttacaggtttgaattaggctaaaaggtcttgcagtggcttttcatggcccttcaaattggaatggaactactgtactttgccatttttctataaatcagtactttttttttaattttgatatacattgtgtgaaaaaagaaaatggctaataaactgtattaaatcttaaacaatgtataaagattgcacttagccagttcaaagtgtatacttattcataatgaattataacagttatatttctgtgttttcttgtaaatgtttcttttcccttaaatacagataattcatttgtattgcttattttattatgagctacaacaaaaggacttcaggaacaagtaatgtattagtatggttcaagattgttgataggaactgtctcaaaaggatggtggttattttaaatataaatagctaatgggggtggtaaa

SEQ ID NO: 217 - DNA, 810 bp, Homo sapien
cttttaggcagcccggcaccttcatccataggcagagagagaactgggtgttggagacttattcgagggtataggaagggccctgtgaagttgatttaacttttggatgtcagactgtgaaagctcctgagaaacttggggtaataggatcttcttttggggatgaaaatggggaaggcgtgaggacctagactacttctccctaggtcagaaaaagagaattaccccttgacaaatatgatacctgctaggtatttcccagggaaatttagggattggcgtctttccctagcatgtggaggaattggcagacagcttcctaagggcggggagcgggggcccaaggctgacactgcttgcatccacgtgaccttaagttatggcagatgactctgaaacggactgaggccaatgagaacagatggatggagcactcaggttagacttgttccttctcctatgctggaggagagggatggttctctagaatgttggaggtgagttgagagctcgcctcttgaatgttgaacagtgtactcttctgaaaactgcatattcactttatgtggtttcagaatactgggctcaatactaacataagaaagacacttcattgagaaattcttaagcttacagaaaacctatctctttgcacattccacataacccctagcaaaatgcaggttcttcatacttctgtcctttttccattggaagaattgcttaaggaaaaattaattcctatttattcccacaaaaggttgggcattgctttgattttaccccatgggggaatgtgcctttgaattt

SEQ ID NO: 218 - DNA, 817 bp, Homo sapien
ctgctcccttatggaggtctcttcattaataattattggatagatagagaaggtgagcctgtggcttccaagtaccggcttttgctgaaggtctacatgggaagaagagcatcatttgatattcagtagatctgccacacccaactggctccatctcctggaaaacagcactcactacaagcaactgtaatagcacccagcaatgaccacgctgctcctgctggctcttccgtacaccagtaaatgaactcaccaatgtattgcacacatacatttcacagtagtacaataaagccctgtatcaggagtggtaattcaatgacttgactctatagtgcactgcagctttatgtcataccaacattcaaatattcaaatatccttccaatccatttggacaaaaatacaccatggctgccaagacacatgtatttttctttcttccatggactcctaaactgctcccacaatcagcagtgttcttctctcagaaattatcttaagcttctctactcaatgggaggtacacacagagacctgagaatatgcagaggccagaatctctgtctgtgctagagatcaactgtactctgcccacctggggaacacatcctctgggtaaagtactcggaagtaaattacattccctggagacagatacgggctttcactgcagcctgttagaaaacacaatgtctgtaagttacctcataggtcaaagagttttggattatatttttcataatggggctatggcctttttaccctggttttaatacagaaccacctgcagaaaggacattgaaattaaaagcca

SEQ ID NO: 219 - DNA, 661 bp, Homo sapien
ggatgctgaggcaggaggattgagtcctggagtttcaggatacagtgagctatgatcatgccattgcactccagcctgggcaacagagcaagattctgtctctaagaaaaggaaaaagaaaatgaatagatagtggtattagatgttaatgacatcagttgtttttattctttattctttcttagaaacagattagttttctcgaattaaagaactaccatttttcttttttctacaactttcaagagctggtgaagaaatgatgtttagatttaatagatatagtagcagtcatatattaatagaatagaaactgagactctaggaaaaagatagacatgagataaggagtaggcatggtagacatttctagattatttatgaaaatgttgtagaattcatttttttttttggtctgacctttggcaatggtgctgaggaagggaaagccagcccatcaggcaaggctctgttttctgcattttatcccgtttgattcttctcgttaggattggagcaaataatttcaatatgttcttcgctgggtttatcatagtgacccttcatttaaagggacttttaacaattgacttaaagaacactgagatgtgatattttattgggatttgaaagttgccattgggttttaccttccttaatt

SEQ ID NO: 220 - DNA, 792 bp, Homo sapien
  misc_feature (1)...(792): n = A,T,C or G
cctctttttattcctacaaataattttcaagtacacacaattgggtaaacaaagaaacaaagccaccaagaatgaaaatcagtaggaataacgaacaagactcacagatgtcaaacaagtctgtgggtcttgcagacttcagatgttggaattattagtcgtggcaagngnncaaaacattagctattaccattatgtttaccaactagtgaagtgaactatgagaggatatattaaccacagaagttaatagaagaatagactcctgaaaatatctggatgctacaaactaaaatatagtatataatccttcatagagtgtcagtgacttcatatttataattacatttttgtatattagcagtgttctagttcttactgccttatctttaagctgannnnaaataaaattatattttgggattcaaaaacacatagctaatgattactatgtggcagtgttacattactttatcacatatcattaacataatctgcatgtgttcaaagagatcttcatacttctttgtagctcccacttctttgtcgtctttgtagctcccacaacatctagaacagcacaaccgtatatggagaaaactcagtctagtattcgttgaatgactaatggaaaatttagttnataaacagaactttcttcattgnacaaattatcttgcagaagaataatggccttagtttaaaattatcatatttacccatntcnccangttattttatctcttttggctaanaattttgaaaacggtaccttttaccctttggcatttt

SEQ ID NO: 221 - DNA, 759 bp, Homo sapien
  misc_feature (1)...(759): n = A,T,C or G
cttttctgctgctccgggaggtggagtggcctggcagagggcacatggctgccacctgctgcaaggaaaattctcagtgaagactcctcagtatgaaggagataagcctgcacaatcagtcactgatagatgcttagtggaaaaacttccaattcccatttacagctctcagagctaggattaaaaactcctggtcataaactcatgtgatgagaagttatagcacgccctcattttctacatanccacttgcatttatggttggcttttgaacttgctagaagggaaagaagtgcaaatgtgtcctccttagagctactctcctccccttggtgggtttccagtttgtgcattgtccagatggcccaggagctgacgatcaaagggaagaagtcatgtttgtcatgagaatgctttgctgcatcaggattcagtgaagctgttcaccgcctggagcccatgcagcctcaagaggcaggatggagctcagaaaccatcactgaggttagaaagtgagcaccaaagttgagggaagcccacaggagtgagccgaagtgctccctttggatttccaaagtgggtgctgctgcttcttccatcagccttgcttctgaccccaatgcgttcctggtgccttcttcttggcattttgctgtcgggggcccaaggaaaaaaattcctgcatggcagtggtgaaaaaagatggctgcctgctgaaacctgatttggcctgggtaagccttttggagccccggttaa

SEQ ID NO: 222 - DNA, 699 bp, Homo sapien
  misc_feature (1)...(699): n = A,T,C or G
ccttntnaagagttggcattaattcttcactaaatgtaggagtagaatttatcaggtaagccacactgacctctggncttnttnncgcccgatgatttttaattagttgaatccctttacttgttatatatgtattcatatattctgttccttcttggatttacttttatgattggtgcctattgaggtatttatttctagtttgtggtacttcatgtgtttaggttttctagacagtggacatagaagattcaagaagctaaatgtaggagaatgtntaatgtagganantgaggcnacnatatcatcaatgaatgacttgaagtttcctctgttgtaaagaatgatattaccataactgccatagntaatattgatggtgtaagtcaaataanaaggcaggaggaaagggacatccatcactgaaccacanatcagagnctcattgaagcctttgagaagaatccacaaaattttacaggataattcatttcctgcgatcaccacnagaagagaaactggttaaacagacaggtattccagagtccaaaaatttacatttggtttcngaaccaaagacctcagctcccaggccacagcaaaagggggcttatgaattccctggcacccagncccaagacccaanaacctcatcttgattggtttngggcttgggaaaccaaaaaaccaatgggtggc

SEQ ID NO: 223 - DNA, 598 bp, Homo sapien
aaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcaatttttgaggatttatctttaggccaggcttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcg

SEQ ID NO: 224 - DNA, 501 bp, Homo sapien
  misc_feature (1)...(501): n = A,T,C or G
aaacctttatgatgacttccttatgaattactgaacgaacactggaatgggactcaggtatcctgaggacatctctcaactctggccttagttccccctctgtaaaattagggtgccaactaaatgatctacaaggtcccttccagcgccgccattctgtaattacatcatgtgtaactgtattaaacatacacaagtgactgccaggcatgggaatgtaacttccgagtaaatgctttggtttgttcagaatacactatgaacttctttccaaagacgggttgtggtaaatagtggatattttgattataagaaatagagtttccttgaagctttagctggagatacagcaatagtgtggtgttcctacaaatatcacagtgtattcaaacatatttttctatcaaaaatcatttttgtaaaagctgtgtgtttttatccaacttgtgataataaatgttctttattttagaacaaanaaaaaaaaaaaaaaaaaaaaaa

SEQ ID NO: 225 - DNA, 295 bp, Homo sapien
cctgtatagggctcgtttccccacacatgcctatttctgaagaggcttctgtcttatttgaaggccagcccacacccagctactttaacaccaggtttatggaaaatgtcaggaaaaaaaaaaaaaaaaacacatgcactcacacaatacccaaacatcaraattagaagggcataaaacagggggctttataggctgaaaaatatcttaratttcaraacagaataccaatcaaatattgaaaattcctttgttcaaaacacaaagatgttttgtttttaatgggagttttttt

SEQ ID NO: 226 - DNA, 372 bp, Homo sapien
agattcctggcttagagcatgcgagcattgaaggaccaatagcaaacttatcagtacttggaacagaagaacttcggcaacgagaacactatctcaagcagaagagagataagttgatgtccatgagaaaggatatgaggactaaacagatacaaaatatggagcagaaaggaaaacccactggggaggtagaggaaatgacagagaaaccagaaatgacagcagaggagaagcaaacattactaaagaggagattgcttgcagagaaactcaaagaagaagttattaataagtaataattaagaacaatttaacaaaatggaagttcaaattgtcttaaaaataaattatttagtccgtatgaaatgaaat

SEQ ID NO: 227 - DNA, 599 bp, Homo sapien
ggcccccgtcgcgggagccgcttcgggccttctgggcatgtctgccatatggctccaggtttgtttttctccccggcactctgacggggagggctcccggcatctcctggcatccgggtagaggacgcggaggatgctgagctgctggcgcactgcagcacaactagagatgtacggatgcccccatcttgatcttacagaatcagaggtacagccgcgagaaagagtcaagaacagacagagtcgcttgaggactcaggagggtgtttgctgcgttgacaacagactacaccctcacagtttgctctgctcttccaacaccagtggaagatgatcacatcccagggatcagtgtcgtttagggatgtgactgtgggcttcactcaagaggagtggcagcatctggaccctgctcagaggaccctgtacagggatgtgatgctggagaactacagccaccttgtctcagtagggtattgcattcctaaaccagaagtgattctcaagttggagaaaggcgaggagccatggatattagaggaaaaatttccaagccagagtcatctggaattaattaataccagtagaaactattcaat

SEQ ID NO: 228 - DNA, 343 bp, Homo sapien
aaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaaccgctcaagtacacaattgtatgttctttgtatcccttaccacaaatatctcgctctgctcatttcttttgcagcttcctataaagtttgtcttcctcaaaaaaaaaaaaaaaaa

SEQ ID NO: 229 - DNA, 417 bp, Homo sapien
ctcaagctgcagtccaccgggtatggttctggatggttcccccaagggagcaggtatgtaggaggtgaagaaaactgagatttcaagtatgggagagtttttactatctccattcctggattaaaagtgctgaaaaagtccacagttaaacattcctttattcaccctatggctcccaagaaaagcattcttcctctggagtactggtgtactaaggggacaatacaccaaatttgttgagtttacaatcaagtctactaaggttggacttccttatcagtttggcagagtcccagggcagaataatcatccatctacaggtctctgtttcctctccctccgcagcagtggagagcatcccagtgtttggggcactgtgttcctcttcgtccctgcaccagaccctggaagccttgg

SEQ ID NO: 230 - DNA, 462 bp, Homo sapien
gaaataccagaagagaaagtttcattgtgcaaatctaacttcatggcctcgctggctgtattccttatatgatgctgagaccttaatggacagaatcaagaaacagctacgtgaatgggacgaaaatctaaaagatgattctcttccttcaaatccaatagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcagtttatccttatgtgggccgatggcagcttatgtgaatcctcatggatatgtgcatgagacacttactgtgtataaggcttgcaacttgaatctgataggccggccttctacagaacacag

SEQ ID NO: 231 - DNA, 328 bp, Homo sapien
ctgtgggttttcctaaacgcccctcatctggttgaagccctagtgtttctttctcacatcagaggcaaatgcattggggtgggtctggtttggacaataaatttcctctggtttggaccaagaaaaacagagttctttgaccgctaacatatatgtaaaaagaaagtttgtaaaaacaagagttaaaatgcttctaacagtgtggtcatcactgcacaggacactggaattggcattcggggttgtgtctgtccatgtggtttcgttgtatgtcatgtgctctcagctcagacagagacatccaattgacttctgacttggggcattt

SEQ ID NO: 232 - DNA, 595 bp, Homo sapien
cgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtccaagaaaaaaaaaagcatacatatgtgattatggctaaatcaaaggtaactggaatgtatatacttttgctaatgttcc

SEQ ID NO: 233 - DNA, 600 bp, Homo sapien
atgaaggtaaactctaaaatcttcataggtcaacaaagaaaatttatccttcacacttatttctagaaagcagcagggcttatttcctagattgcttacaatgaagctagaatatctgcgataactgtagagtttcaaaaaggatccctagggctacttctacgttctccttaccagttgagcactctccataatttccagacgggtcatgggggagaatgatagaaatgagcgtgggaagaaagacaatgaaattagaaatgggtgagacacatggtggtagaatgctaagagcagggatcaggacaatcaaccaggtgtctaggaagggtcaagtcaccagtgtcatctgctgaccaatgttaggaagaaataaactcaaaggaaacaccacatttttccaattaaactcaaatctattgacttgtggtggttctttgatgttgtggggactgctataacagaaaccaattggattttcaagggcaagaaactttgccactgaataagatgatgtcatccttcctgataacaaataggaatgggtggtcagctctaaacagcgtggactgagggagttgcttttctacaatattactt

SEQ ID NO: 234 - DNA, 500 bp, Homo sapien
aaattcctaattcttttactatcttctcaacttttcccaaagataaaataaatttcacataatttcatggaggggaaatggtagttgtaaaaaactacctcaagtagcaatcaccgctggcagtgttttctcactttctgttctgcaattgcaatcacacttccaaaaagaaaagcaaatgtttgctaaaccatagacagacaacctctttgtgactggtattataaggtttataatgaaaacttatcaaatataaaaggtgctccctcttgaaaatgtgtattttatttgaagttttgagtaagaggtgagtgtttggcaattttcaacactcccctcaaaaatctcccaaagttgcaaaaaagtcagtttagtaaaattccaagcacttaaatgcttcattgagggccagttgatatacgcaatgcactaatgtgtaaaaattaaccgaatgcaactattttataatggagagctcttaccttttccttccagttttt

SEQ ID NO: 235 - DNA, 159 bp, Homo sapien
aaaatttacagataaaggcagttcaatactgccactgagaagtacatctcttaacatatacaactttcaggccacagttttgaaggtctgaagtattaagttggtttgatgaattagtcggttggcacttacgaacacatttattgccttgccatcttt

SEQ ID NO: 236 - DNA, 254 bp, Homo sapien
aaataagtgaataagcgatatttattatctgcaaggtttttttgtgtgtgtttttgtttttattttcaatatgcaagttaggcttaatttttttatctaatgatcatcatgaaatgaataagagggcttaagaatttgkccatttgcattcggaaaagaatgaccagcaaaaggtttactaatacctctccctttggggatttaatgtctggtgctgccgcctgagtytcaagaattaaagctgcaagaggact

SEQ ID NO: 237 - DNA, 591 bp, Homo sapien
  misc_feature (1)...(591): n = A,T,C or G
tttttttttttttttttttttttttttctaatttttactttttctcaagtttaatgtaracatacaaraaaacatcaagcaatgtttattgkgcaattccaatcattatttgcaraatcttggtttaaagtcagtytttatagccatttcaactgcttggtttaaacaaaaagcaacaatctggttatytacctataaatttcatggtatttytttaaacactgaagtactaaaagcactgatgatttgtattataatttttaaaatatttaaaacctacacagatttcataratcattccttttataaaataatcaaaataatttgattatytggaaaaaaaaattcttgaaacaragccctttccaggtatyttcaatctctgtaaaaccccaaaccccaaacagagtaratgatgaaataaggatttctcagttgcccaagactgtctgaaatttaaggttgaaaaatggactggcgtttttcatgtttcctgngaattcanagcttacaggtggcatcaaaactcaaatctctgggatggctttacatggctttcactttgatttgtttcattttcatttgcttctt

SEQ ID NO: 238 - DNA, 252 bp, Homo sapien
aaatggcttttgccacatacatagatcttcatgatgtgtgagtgtaattccatgtggatatcagttaccaaacattacaaaaaattttatggcccaaaatgaccaacgaaattgttacaatagaatttatccaattttgatctttttatattcttctaccacacctggaaacagaccaatagacattttggggttttataataggaatttgtataaagcattactctttttcaataaattgttttttaattt

SEQ ID NO: 239 - DNA, 153 bp, Homo sapien
ccacaataaagtttacttgtaaaattttagaggccattactccaattatgttgcacgtacactcattgtacaggcgtggagactcattgtatgtataagaatattctgacagtgagtgacccggagtctctggtgtaccctcttaccagtcag

SEQ ID NO: 240 - DNA, 382 bp, Homo sapien
aaaaaaaccatctaaaagtggttttttaatatatatattttttccaaaggaagaaatttcttgcttttactcagggaaaaaaaaaaattaaggtacatttgagtagaatgatttcatctaaaagagttctttcaggagacatctgtgattcactgcattgtttttattttcttctttttcctcttcttttccaacatttctaccattttcctcttcttggttgatatcaggccactttcttttgttgctttcttactgtcacctgttaaaccgcgtttctttgtgttaggttttgaccgcttttcttctttgtgcactgtgtcaccaggctcctttttgccaattttggactgttctttacttacaggagaaggctctgcag

SEQ ID NO: 241 - DNA, 400 bp, Homo sapien
ggcatgagccaccgcgcccggccctatcttttacttttataaatagagatgaagtttcaccatgttgcccaggctggtatcgagctcctgggctcaagcgatcccccaaccttggccttccaaagtgctgggattacaagcgcgagccaccgaaattattcttaactagcaagactaggctctgacatcacatccttatagttacatccctttaagcagggttcagccactcactctgcacctggagaacttgatggttatccctcgaagtgacagtcctgcaaatgacaaaaacactccaaatctattaggttggtgcaaaagtaattacgctttttgccactgaaagtaagtcccacaggaccctgagggaaatgggagggtggggtatacatagcag

SEQ ID NO: 242 - DNA, 75 bp, Homo sapien
actcacatatgcagacctgacactcaagagtggctagctacacagagtccatctaatttttgcaacttcctgtgg

SEQ ID NO: 243 - DNA, 192 bp, Homo sapien
gctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttgg

SEQ ID NO: 244 - DNA, 616 bp, Homo sapien
aattttatagcaatatactgaccattctaaaaataacaaaatacatgttgctctcaactacatagttaaaaaaggtagtaaattctcttacccaaaatagaggaggggtgggctagtgagctgctcaaacatttgtaacaaataaaaatgtatctatatacatataatgatcatgttttcatagcctaaaatcaccatacaaaatctaataataaaattgtgtcgtgttcaggagttgggaagccaacacattaaattaacaaagtatttttggtatatgtaaataatgggatagaatctctcgaatcaggattgtcccagaagttctaaggcagatgtcaatgacatgcacattgtccatgttcagtaattttcaaagactagaataaactatgtaaactattcaatacaattcaatattacttaactgctaaaaagtacttcaagatcttgcactgccttgagtgagtataatcaaattagtaattggaaaatagctgtaatagcaggcactgaagaattctgacaaataccaaataactgtttgtttttaccaaataaactggtaagatgatatcacaaagggttttaagttattttgctatacaaggttttt

SEQ ID NO: 245 - DNA, 165 bp, Homo sapien
ttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaagg

SEQ ID NO: 246 - DNA, 229 bp, Homo sapien
tgtactggatccctccaggtgggggcgactctcacctgactattacaatagcctcctaagtggtttccctacttgcaaccttgcccgtataatatctatcctccacacagcaggcagggcgatcctttaagaatagaagttagatcatgaaaatgctctgctctgatccctgcaaaagctcgccacctccttacagtcaccgctgaactcgtagcagaggttcaggagg

SEQ ID NO: 247 - DNA, 338 bp, Homo sapien
  misc_feature (1)...(338): n = A,T,C or G
ggaaaccgtgtgtacttatcctggatgatgccaccagtgccctggatgcaaacagccagttacaggnggagcagctcctgtacgaaagccctgagcggtactcccgctcagtgcttctcatcacccagcacctcagcctggtggagcaggctgaccacatcctctttctggaaggaggcgctatccgggaggggggaacccaccancagctcatggagaaaaaggggtgctactgggccatggngcaggctcctgcagatgctccagaatgaaagccttctcagacctgcgcactccatctccctcccttttcttctctctgtggtggagaaccacag

SEQ ID NO: 248 - DNA, 177 bp, Homo sapien
tgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaa

SEQ ID NO: 249 - DNA, 263 bp, Homo sapien
aaagtaatgactttattaataaatatacatccatatgatgatgtagatacaaatcatgaacactactccattcccatacacataattgcacacgagtagctcaagttcatggacataaaaacatacacagtatctattcagactttttacagcagaggacagcgtgcttattatcagttaattggtaattattttctccaaaattacctgtggaaaaaagaaattctgaaaacttaaaagaatcaaagtgatctgattacttt

SEQ ID NO: 250 - DNA, 333 bp, Homo sapien
aaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgcctcagaccatcttgtgagattgtttgcctatctcataatacagttttatgcagaaaggttgaaactatgtaaatggtttttatggaaattatcagttacaatatttt

SEQ ID NO: 251 - DNA, 384 bp, Homo sapien
aaaccatttgtacaaaacttctataaatttttctctctctttctctcttatgtacaaaaatatcttaatatatccccgaactggttaggatagatacaaatagattttttataataaaaaattcacaaaagattggaagcattctataatgaaaatggtagaaaagacagtgtgagggaagccatggggtttgggaatcgggccctggaggagaagcagagtttcaaagggctgagaatagcatagtttcactgtaaaccaatgtctacagcttattggggtgggggctactgagacgaaagacaccaactcgtttctagagggctaagaactgcactttaagaaagggcggggaggtgaagggacccgagcaagaactttcag

SEQ ID NO: 252 - DNA, 211 bp, Homo sapien
aaagcagtctgaaaatgggacatctgtagagaaattcatttccttcttctcctccggatgtggaatggaagctttgagggaaggaaaagtaggaaaagagcgggatgggatgggatgggatgggatgggatgggataggaagagaggctggggaatgggcagagaagggggtgctgagtgtgctgtgagatagagcaagatcacaagaagg

SEQ ID NO: 253 - DNA, 135 bp, Homo sapien
aaaaattgtttcttgacaagctgacttggcacttaagtgcacttttttatgaagaaaaagtacaatgaactgcttttcctcaagcaataattgtttccaacttgtctgggaattgtgtgtctggtaactggaagg

SEQ ID NO: 254 - DNA, 361 bp, Homo sapien
cctgtagcccctgctacacgggaggctgaagtgggaggatcacttgaaccaatgagggtgaggttacagtgagcccagatcatgccactactctacaggctgggtgataagagtgagaccctgtatcaaaaaaaagacaaggaaaaaaaaaactgggccgtttgtttttgcagaatgtctctcaatttggactttttgggcaggaatacaatacaagtgatacaaatgcttctttaacattagaacctgtataaaattaccattacagaccttgctattttacttataggtaaatcactgtttaccaaggtaagtcttttgggaatttccaaaaatgaagtccatggacagttaaaaactg

SEQ ID NO: 255 - DNA, 331 bp, Homo sapien
aaaaaaataaataatccaccaacgtgattgaccttggcgagatcatgtttctagtctatacctcagtttccccatctgtaaagtgaggataatgtcccaccccatgtaactgtggtgaggaccaactgcaacactgtgcctgcgagtctccttggaaaagtgtaaggttctacacaaatggaaagtgatctgatcacactcagtgtccccagcccagcctttcagtgccctggccctggggtgggggacaatactctcctcacccccttcactagtcttcatgaatagcaaggaggccataacataatttggtctaaaccccttccttttt

SEQ ID NO: 256 - DNA, 186 bp, Homo sapien
  misc_feature (1)...(186): n = A,T,C or G
cctttgggcccttgcactttgacctgcaatggggccacaccagccttgcttgtgtccacctggaaggactgagggaggttggcacgaaccatgcctgggctcaggccgggcccanagcacttgaccttggacgcatctgtcacatcatgcacagggaccttgaaaggactgcctggcacttgatgg

SEQ ID NO: 257 - DNA, 255 bp, Homo sapien
ctggggtccgtcaccgacctttggggaactgggctacggggaccacaagcccaagtcttccactgcagcccaggaggtaaagactctggatggcattttctcagagcaggtcgccatgggctactcacactccttggtgatagcaagagatgaaagtgagactgagaaagagaagatcaagaaactgccagaatacaacccccgaaccctctgatgctcccagagactcctccgactccacacctctcgcggcag

SEQ ID NO: 258 - DNA, 604 bp, Homo sapien
ctgaatttgcaatggagtttggtggtgcaatcggtattgattagtttggcatagacagatgcagcagtttagagcaaaatcgagaaaatgattttttttttcctccttgatttcctggcagaagatatcttactttttcagcaaacttttcttttaacactaaagcagcctagggcaatgccagatacttagagcttttctcttgattataagtagaaatgggggtgtctgggctagaggtggagggtggatgtgctgtcgtcacagtctagctggcagcaagcaaggcaaaagcagagactgctctagaagcggttccaagcagcagagacgtcaggaaaggcacttcttagtaccaacctctatgctttaatagttgcttgttaagctgcttcatgggttgagacaaactaccagcacttcaaagagctcagttctctgctcaactctcttctctagttacattattttttttccttcaggagactgaggcaggaaaatcgcttgaactcaggaggtcgaggccgcagtgagccaagatcacaccaccgcactccagcctgggccttgcaaagtgctaggattacaggaatgagccaccagg

SEQ ID NO: 259 - DNA, 429 bp, Homo sapien
aaaaatgtctgtatcgagatcttccagtttgaagtcttcctcctctgtgtcttcccaaggctctgtggcaagctccactggttctcccgcttccatcagaaccactgacttccacaatcctggctatcccaagtacctgggcaccccccacctggaactgtacttgagtgactcacttagaaacttgaacaaagagcggcaattccacttcgctggtatcaggtcccggctcaaccacatgctggctatgctgtcaaggagaacactctttactgaaaaccaccttggccttcattctggcaatttcagcagagttaatttgcttgctgttagagatgtagcactttatccttcctatcagtaactgctccgtgttcagactcctggtttcttccaggcttacagtggacatcatcagcttcctgcttt

SEQ ID NO: 260 - DNA, 385 bp, Homo sapien
  misc_feature (1)...(385): n = A,T,C or G
ctgcaacacatgcagcaccagtctcagccttctcctcggcagcactcccctgtcgcctctcagataacatcccccatccctgccatcgggagcccccagccagcctctcagcagcaccagtcgcaaatacagtctcagacacagactcaagtattatcgcaggtcagtattttctgaanacgcatatggcagacggatttgcgtataccaaggagagtggcataggagggaaaagcatatgtggctgaaacctgtaagttggtgttggttatgcagaaatgtgtaacagatcaaacggtcctctcaagtgtctattanataggcaataagaactgcagtgtagctgagtaacatcttttagctgactataaatcactttgttttt

SEQ ID NO: 261 - DNA, 230 bp, Homo sapien
ctgtactggatccctccaggtgggggcgactctcacctgactattacaatagcctcctaagtggtttccctacttgcaaccttgcccgtataatatctatcctccacacagcaggcagggcgatcctttaagaatagaagttagatcatgaaaatgctctgctctgatccctgcaaaagctcgccacctccttacagtcaccgctgaactcgtagcagaggttcaggagg

SEQ ID NO: 262 - DNA, 198 bp, Homo sapien
  misc_feature (1)...(198): n = A,T,C or G
atgttaagtaaacatgaaatctatataacagaacaaaaattcactcttatgtcaatgtcagcgtgttaatgtagatctatttactganacagactctgtagtggcagagagtggccttgttaagccaggaccctgttctgcaggctgtgggtagaagctaggaagtccctggagtttcacccagcttttccatgaatg

SEQ ID NO: 263 - DNA, 157 bp, Homo sapien
aaaatatatttctaaacagaatgggccgactcagtcacagtaactgttgatctccatagtagagcaacccacaaagacagaactgatttttttcccataatcaggggtgaaaaatatacaacttgtttctgaaccaaaaccacaatttctgcagttt

SEQ ID NO: 264 - DNA, 290 bp, Homo sapien
ctggctactccaagaccctggcatgaggctgaggacaacttacaagggcttcaccgaagcagtggacctttattttgaccacctgatgtccagggtggtgccactccagtacaagcgtgggggacctatcattgccgtgcaggtggagaatgaatatggttcctataataaagaccccgcatacatgccctacgtcaagaaggcactggaggaccgtggcattgtggaactgctcctgacttcagacaacaaggatgggctgagcaaggggattgtccagggagtcttgg

SEQ ID NO: 265 - DNA, 234 bp, Homo sapien
aaaaaaaggaaaggaaagagaggaaaagaaaataaaataagacgatttattgcttctcctcagcatcctccttggtctcctccttcaccgagagagcttctagcttttccgccactttttcggcatgatcatttttgcctgatcctttcttttctctctcttcgatctctttcctgcattcttcaaactttgttttgaatttctgtgcattctcagcattcaggaagcggatgg

SEQ ID NO: 266 - DNA, 335 bp, Homo sapien
gtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagagtatatctggctccttgaccagcaatcggccctgggagccaccaggtgggaaaagcgcctctgccagagtccagg

SEQ ID NO: 267 - DNA, 619 bp, Homo sapien
  misc_feature (1)...(619): n = A,T,C or G
tggagctctgacgaagggatcggggaggtgctggagaaggaagactgcatgcaggccctgagcggccanatcttcatgggcatggngtcctcccagtaccaggcccggctggacatcgngcgcctcattgatgggcttgtcaacgcctgcatccgctttgtctacttctctttggaggatgagctcaaaagcaaggtgtttgcanaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcanaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccanagaccatgtgtgagatgataaagatcatgcaanagtacggggaggtgacctgctgcctgggcanctctgcca

SEQ ID NO: 268 - DNA, 147 bp, Homo sapien
cctataacccagacaccagcatggacaaaactcagttatactgaattcagagacaaaattcagtgacactcttctaccacttatttagggttctacagcatttcactgagcagacttagttttttgtttttgttttacaaacctttt

SEQ ID NO: 269 - DNA, 325 bp, Homo sapien
ctgagctgtaggaatgggttcttggtacacaagatagtattgttgagctagttttcgagctctgtgcacaagcactctgtaatcggggcccatgccactgtacaccaaacctatatgcttggtaattggttctactttgtgtacacttcgctcatcatacagaatggatttctgttttttctcagttgctaataccacaccatttgcagctttaattcccacggacggggctcctccagctacagcagccaaagcatattcaatctggacaagtttaccagacgggctgaatgtagtcagcgaaaagctgtacccgcgctccgcc

SEQ ID NO: 270 - DNA, 428 bp, Homo sapien
aaacatatggtaaattaccgagtgacacctctgggctagagacctcttttgaggggagtttgcaaactacggattcaatttctttaacagttatgaagttctttaaagaacctgtttggtattggggggttgtggtcacctgtgcttttctgagatttggcccctacatctaagttgttgaatgcatgtgtgtagagttgtttatggtgcttccctttcttcttagaagggtctatagtaatatcccctgccttatccctagtagtactaatttgtgttttcttacttcttgacaggcaaacacatcagagcataagtggttcctaatgccaagctgacctcccttgatctctgtcttctacaggatattgacatgggacttctttattaccttttcagttcactgataccttcaaatagctttattt

SEQ ID NO: 271 - DNA, 206 bp, Homo sapien
  misc_feature (1)...(206): n = A,T,C or G
cgtcccggagcccacggnggncatggctggcanagcgctctgcatgctggggctggtcctggccttgctgtcctccagctctgctgaggagtacgtgggcctgtctgcaaaccagtgngccgtgccagccaaggacagggtggactgcggctacccccatgtcacccccaaggagtgcancaaccggggctgctgctttgactcca

SEQ ID NO: 272 - DNA, 83 bp, Homo sapien
ctggcttccctgagaactcaacaatgccttttcctgagggccttcctcgatcatccacaatgactacagccctctctacctgg

SEQ ID NO: 273 - DNA, 472 bp, Homo sapien
ctggagaaggtgtgcaggggaaaccctgctgatgtcaccgaggccaggttgtctttctactcgggacactcttcctttgggatgtactgcatggtgttcttggcgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctgctgtgagtccag

SEQ ID NO: 274 - DNA, 205 bp, Homo sapien
ccaggcggcccgaggacttacggtcggcacttctctgttctcccgtgtcagcgtgtggtgtcgcctgcatgggtcgtacctggatggtgtgtccaccatcgacacggaggggctggatttgtttctcaggcaatcctgtattttaattttagatgtatttcctgaagcatatttttcatagaatgtagcgtgtaaatagcttttt

SEQ ID NO: 275 - DNA, 308 bp, Homo sapien
ctcctcgccctccccaccgacatcatgctccagttccagcttggatttacactgggcaacgtggttggaatgtatctggctcagaactatgatataccaaacctggctaaaaaacttgaagaaattaaaaaggacttggatgccaagaagaaaccccctagtgcatgagactgcctccagcactgccttcaggatatactgattctactgctcttgagggcctcgtttactatctgaaccaaaagcttttgttttcgtctccagcctcagcacttctcttctttgctagaccctgtgttttttgcttt

SEQ ID NO: 276 - DNA, 201 bp, Homo sapien
aaattaactttttcttgcaaaatattcatttcattttttccaagaaaatcttataaaggcaaaaataaaattttattttggcaaatgtcatgaagtcgatactggcagcatatggagttagttaaaaatagacaacaactgctagatatattcaaaattctatttttttttctgagcatagtcaaagagaaattttcattt

SEQ ID NO: 277 - DNA, 520 bp, Homo sapien
  misc_feature (1)...(520): n = A,T,C or G
aaaaaaaaagtattcagcaccatttgctcatnggtctttcagagtttgttcttaaagtttctggaactttcctgtctgtaaagtaacaggaattactgagctacattggaaagcctctctgggacaggcagtggggagttaagcagtcatcataaaggaatcagtgtacattcagcatggtgacttgactacacaacaatcccttcccctctactgtagctcaagagagacatgcttctaaccactgaggtatgaggagtctcagactgttatttgctgttagaattggtcttcccagctaataacagtacatctctggcacagatgctattggtccttaatgtcctgtgattttaggaaatagtttggatttagttcaatttattcagaaaccaaacgtgtttaattagcttcactactctggcagagtaagggtatgctggtttagtatctttataaaatatatataatgtataggtaaatcatagtcttaaatcatacctaaaatactgtatcattt

SEQ ID NO: 278 - DNA, 264 bp, Homo sapien
cgcgccgggcggaactttccagaacgctcggtgagaggcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggccttgaagtaccatcctgataagaacccaaatgaaggagagaagttt

SEQ ID NO: 279 - DNA, 414 bp, Homo sapien
aaacatacaataatttttattatggaaattaatctttacatacaaaatcagctacgtaattttacttacaaaacaataaaaactgttctttactgtggcaacaaaagaagcattttgacaaatgaaaaaaattaatgcaaacaaattaaaacaatgcttttctttttacttgcttcactgtctcttctatttattttctatgatcatttgacacaaacatggattactttgatatctactgaaacataaatgataaggttcttaaaggttgaattaaaagtctgggtgttcaatattttagaagctgaataaacaaaacgaaattggggtttgtgattacagaggatttatcattttttccctttgtccatatgaaaatatataatagaaaattacccacgggaaaacattttt

SEQ ID NO: 280 - DNA, 262 bp, Homo sapien
ccaccatgcctggcctgcttcaattttttgatgccactttgtaaacggcacttaattatggaaaataggaaaaagcaaaactaaaataaggaagaggatatatatataacttttcacaatctcttttctgatcccctttagatgcccagtcaaccaggaccacacacagatttcattttatttgtagagtatatgaaaagatttaatagtctcatgcattttattttacgtatactgatttctacgttttgactgactattt

SEQ ID NO: 281 - DNA, 349 bp, Homo sapien
ctgtgacccgggtgcatcagtggatatagttgtgtctccccatgggggtttaacagtctctgcccaagaccgttttctgataatggctgcagaaatggaacagtcatctggcacaggcccagcagaattaactcagttttggaaagaagttcccagaaacaaagtgatggaacataggttaagatgccatactgttgaaagcagtaaaccaaacactcttacgttaaaagacaatgctttcaatatgtcagataaaaccagtgaagatatatgtctacaactcagtcgtttactagaaagcaataggaagcttgaagaccaagttcagcgttgtatctggttccagcag

SEQ ID NO: 282 - DNA, 381 bp, Homo sapien
  misc_feature (1)...(381): n = A,T,C or G
aaacactaaatgaagcttctcacaatttctaattataaacaaaaggctgaaaacagtatgggaaacaaagtttcaaaacaaagaaaagttgagtaaaaggtgccccctctatggctcatctgaaagaaacattttactcagagaggcaaacatttctgatctaggagtaagtttcccactcactttgcaaggacccactcattctgcanaaagacctacaagtctttctggtctcaattgcaaagtacgtgaaaatgtgtatgaaagatctaaaagctaaatattagaataaggctaattgaaatcaaaattgtgtgctggtctaaatatacatcttcggcttcttcctttttagtaagtatttttatttcagatgtattt

SEQ ID NO: 283 - DNA, 543 bp, Homo sapien
aatatagctcctccctacccccaacaatggaccctgcccattgcctcccagttccttgatcttcctaggttccacaactctctttttccttttagttttattccctccagccaaacctctcttattcaatattttgagccaatgggggagttatgtagatttttttccctacacattagctggccccttttatgaccaatgactcataaggcaagatgtgtggtggcatcttcggacaggcagcaggctttaatagggcagcctgggttggtggaggcaagcaaagctaattggcatgcgtgggaatcaaaccccaggccctgggctcattagcccatggtcaaaacaactgagccagaggaggtaataatttgcccaagaatatcagtagttcctttattagaagaaaatggctgatatggaagttggggaatctgaattgccagagaatcttgggaagagtaataagctcttagtctcaacaaaaagtgttttttcatctcagcgcgtaaagggtgctatatgggaacaaagaagtatttt

SEQ ID NO: 284 - DNA, 147 bp, Homo sapien
aaactggtattttatctttgattctccttcagccctcacccctggttctcatctttcttgatcaacatcttttcttgcctctgtccccttctctcatctcttagctcccctccaacctggggggcagtggtgtggagaagccacagg

SEQ ID NO: 285 - DNA, 316 bp, Homo sapien
cggccgaggtctggcttcactcctactccctctctgctcgcagcacgtcggccgccagctctttgatgtgttcccaggcccgctgcacatgggcagattccaccgtgcgagaacagatggcaaagcgcaggacaaacttgtccctgaggtgacatggaaccaagtggatttttttggcactgtttattctttgcagaagagcttcattcactttgttggaaccctttagccgaaagcagacaagccccagaatgacttccacacagatttcaaagcggggatcctggcgcaccagtgactcaaactcatgggacag

SEQ ID NO: 286 - DNA, 322 bp, Homo sapien
cctggggagccctttagtggggtgggacctcaggcagacccccaaaccaaagggagccagatgcccaagttcaagtcattagtgatatgtggcagggctgacagagaaataatcctggaggtctccaaagctgctgggaatggaatggcgatgaaaagcgcaggagtgggcagggtgtggtgggtgatggtggcctcactcagagtggaccaaggccccagctccttgcccaaaaccaaagcccttgggcccgaagtttttagcataacatcctttgcagtaaatctcgccatccttgtctgccagggtggttgactcaagg

SEQ ID NO: 287 - DNA, 364 bp, Homo sapien
ctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagagg

SEQ ID NO: 288 - DNA, 261 bp, Homo sapien
aaaattataactactcattctttctttagccttagttaatttgagcagaagccacaacaagcaaaccacaataaatttagaattggcagaaatccacattaactcctcttcccaagtttccacactactaccatttacagttgtaggtttgtaatgtataattatgtaatgcagaaactagctttgacttgtgtaacgatgcactgtcaaagtaagcaaagtaagaattgaaattccacattcccagaatttaacactcag

SEQ ID NO: 289 - DNA, 261 bp, Homo sapien
ctgagtgttaaattctgggaatgtggaatttcaattcttactttgcttactttgacagtgcatcgttacacaagtcaaagctagtttctgcattacataattatacattacaaacctacaactgtaaatggtagtagtgtggaaacttgggaagaggagttaatgtggatttctgccaattctaaatttattgtggtttgcttgttgtggcttctgctcaaattaactaaggctaaagaaagaatgagtagttataatttt

SEQ ID NO: 290 - DNA, 92 bp, Homo sapien
ccactacccgaacttacaggtgccaaaagaagaaagggtataaacggagaccacctatcactcatcagaacctaggatcatcacattccttt

SEQ ID NO: 291 - DNA, 287 bp, Homo sapien
ccatggctccgctcagggccccggtcacctccgagtcactctgttccttgactgtctttgtgtttctgtacctcaaggcactgaagctggaggactctgtccatgcctgtgtcaccctcgtgtgggagcctctgggctcggcaggtccacatttcatgagctgaggcgtgggccagggccatctggaaagggaactcggcttttccagaacgtggtggatcatctgtcgggtgtgtggtgaacacgttcagttcatcagggcctacgctccgggaaggggcccccag

SEQ ID NO: 292 - DNA, 270 bp, Homo sapien
ccattgtttcctcgctggcgaaggctccttgaacatccctcaccttcctctcccgcctctgccttctgctgggtcaaaggtggccttttctctccagccttgaattgttccctgttggcttcccaagggcccatctgctggtacagtccacacttccacagccaagacccgagagggctttcactgccccaagcctctctcctgtgaccctgggattctgtcttggcagaatcctttgtcagcggctcttactctgtccttcctgtttgg

SEQ ID NO: 293 - DNA, 333 bp, Homo sapien
ccatgctcgtcaacctggtgtccactgcttgctacgtctccttcctcttcctgggctgcgacactggccctgtggctggggttactgttccctatggaaacagcacagcacctggctcagccctggacccctactcgccctgcaataataactgtgaatgccaaaccgattccttcactccagtgtgtggggcagatggcatcacctacctgtctgcctgctttgctggctgcaacagcacgaatctcacgggctgtgcgtgcctcaccaccgtccctgctgagaacgcaaccgtggttcctggaaaatgccccagtcctgggtgccaagagg

SEQ ID NO: 294 - DNA, 123 bp, Homo sapien
ctgatacaaatacagaaaactctgcccattatccaagaaacaaataattaagactaaaatgcaagctgatgtgttgcagcattgtagggccactaaatagccatctgtgattcgtggcaattt

SEQ ID NO: 295 - DNA, 311 bp, Homo sapien
ctgcatacagacatttgtttaggtcatctggattatcttgattgtcaccatggcaactatccacaaccagtgcctaggtgtgtgagaagagtgatacaataatactgtggcatggtcatttagctaatccagtctaagcctaacagaaaccttttccatcaaagtttttcagagaataacaacatctcataagaggccagaggatggcttgtgcttaatatcacacctgtacagtagggcagtgcttcccaggctgtctgcttacattttagcttgtcttacggttacatatggttttagtattttcattt

SEQ ID NO: 296 - DNA, 241 bp, Homo sapien
ctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggcttta

SEQ ID NO: 297 - DNA, 295 bp, Homo sapien
aaacacaagatgaaaatactctgttctgtccaaagcatcacctaatggtgtgaggcatctcacttagctgtggagaagtccttggaattagatctcagaaagacagctttaagacagtaaaaccttttggcaatgggctaattgccttaaaagaagagttctacctgaaagaccttgcaggtggagaaattgtcctacaaagattcttggatatgttagtggagataactgacatgggtagctgtgggtcaaccaggaactgtcaacaacctgatctctgcaaaaccaggatgga

SEQ ID NO: 298 - DNA, 347 bp, Homo sapien
ccaaaataaagcttcaggcaagaggcaaagatccagtggaatatgggagaatggtggaggaccaacacctgctaccccagagagcttttctaaaaaaagcaagaaagcagtcatgagtggtattcaccctgcagaagacacggaaggtactgagtttgagccagagggacttccagaagttgtaaagaaagggtttgctgacatcccgacaggaaagactagcccatatatcctgcgaagaacaaccatggcaactcggaccagcccccgcctggctgcacagaagttagcgctatccccactgagtctcggcaaagaaaatcttgcagagtcctccaaaccaacag

SEQ ID NO: 299 - DNA, 268 bp, Homo sapien
aaaaagtaaacatgaaaacatcacgaattgtaccatgattcaagaataacttttgtaatagaaaacacatgaccttttgcagtatagtgtgataccgaagtaaaagtgaaagaaataaatgcaggaaagtttaagtggatgtaagtttttataaggaaagtaataagaggaggctgcttttgaaggtcctttgatcttccatgatgataatatcgttgcaaagttctttaacttgtattcaagtaattagcagttgaccacttggttt

SEQ ID NO: 300 - DNA, 185 bp, Homo sapien
aaattggagaaggaagttttcctgaagagccagaatccttgctaagtcatttagatccaactgaccatctttatttctgtcaaaaatcttcatcatggtgccggtgtattcttccagtttagcctcagaaatggcctttctgtggtgaagaaagaggtctcggaggaagttgcggagctcagcag

SEQ ID NO: 301 - DNA, 75 bp, Homo sapien
aaaattggaaagtgggataagaaatctaaagtaaccagcttatctttgaaacaatattattttgaaattggcttt

SEQ ID NO: 302 - DNA, 247 bp, Homo sapien
  misc_feature (1)...(247): n = A,T,C or G
ccatgttctctgaattgggtgcagaagacaagggcagagtggctgcggcccctattacctttgtagcagccacatcagaaagcagaagaaaacagtatttctgaaggcattgtttgaggttgatctcagcactgaacgatttcaagccctacgcaccanaacagaaggagggtggaggaagtgatcanagggaacgagctgtaggtttgcanaaatgtgtgaaaccaaaatgatcactgcctacttg

SEQ ID NO: 303 - DNA, 535 bp, Homo sapien
ctgcttcagaggaaatcactgaaaaataaagaaaaaccatccatgcatggctgcatccagtgtacctgtaatcctgaagaaaaggtcctaattccttccatgctgaaatgctagctttggtttcagagagagactttattgcaactgtgaccaccgtcactggtgagcactgctgttcggcccccagcggacttaaaagactggaatgtggtagtggcggtcgttctcggtcagcagggagatctccggccagtccctgagaggctcctctgggtagcagacttcaaagtctctggagttaaacttgaacagtctgaacacttttatctttacttcaagggagtatccaagtataaacatatcaatctgctctagtccacatgtgtcgcctacagaattcaggtgattcatcatgaagctcaaaggatcagaggatgtctccctggaaaacaggagtctaaaaagactgggaatgacctttttagtcttcatttgttcataaacttcagtgacttgatacagcatgatgaacttt

SEQ ID NO: 304 - DNA, 522 bp, Homo sapien
ccgcgctcggtctacaatcacgttttattattggctcgtctagtcatgggatagagaaggtaaatagcaaaatagaaagaaaagggggaaaaggtagaaggcaaggggaaaactattggttttagatctttatcctggtcctgtcaatgatcaggtaattggaaggatcaaaattaggccaaacttggtaattgggccaaaattgaaccaaagtttgtgtcaagaagacctggggcagagatatgtgactaaatcatttggaatatgcccagaccccaagaatatttatgcccaacttgaatgctaaccagaagtcccttactgtagaagattgtaaggttgctatttttttgccccgacaccaaaatattgatgtattttccaacaccaattctccaattctctgacaccaactcgatgttcaacaattcagttatattctgtcactaattcctgcagctatcagcaggccccacaggtaaaggattcagtctcacaagattgcccccccacccacttcag

SEQ ID NO: 305 - DNA, 165 bp, Homo sapien
cctaaagcgctcctcgctgaagctcaaggggtccacaatgatttgtttgtcaaagttattgagtgcatatgccagttctcctcctcctccaccctggtgctgtgaggcatcgtctgaggcagtggcctgggctgcattggaaatgcctgtgaccgcctgctgcag

SEQ ID NO: 306 - DNA, 294 bp, Homo sapien
ctgcacctaagacatggccctggctaggcgggaacagctcacagtagcgatacattcacaggacacagttggtgtccagaaaagggggctcagaacacagtttctacacaagcacttggcacccacacgacagagacgtcactcaagcagcacagccacaaatagtttacagcagctcatgcccggcatccgcccatgctgggagactccctgaaaggtgggcacctgccgtctatgaggaggtgtctccctccatcattaaccccaaaccacacaatgtgtgaggagagcagg

SEQ ID NO: 307 - DNA, 181 bp, Homo sapien
aaaaatccatgacaccttgatagaaattagagtttacacaaacaaaaaaggaaccttcgatattgccagcagctataaagtgaacgtactgagaccgacaggacagcaagaaggcatttgcacatttatatctgacacccgaccatactttcagtcaccagaatatcttctctccagattt

SEQ ID NO: 308 - DNA, 179 bp, Homo sapien
  misc_feature (1)...(179): n = A,T,C or G
aaggctgaggactgctgggagctcagatcagcccggagctactggctcatgggcagccaaaaaatactggatctgctgaacgaaggctcagcccgagatctccgcagtcttcagcgcattggcccgaagaaggcccanctaatcgtgggctggcgggagctccacggccccttcagcca

SEQ ID NO: 309 - DNA, 129 bp, Homo sapien
  misc_feature (1)...(129): n = A,T,C or G
ctgcccgcttgcccgtagctgactcagnttcctcatcttcatctccatcctcttcctcaccatcaccttcttcttcctcctcctcttcctccccaccttcttcctcttcttcgtctacctcattgtcag

SEQ ID NO: 310 - DNA, 390 bp, Homo sapien
tgaggctgggggagagccgtggtccctgaggatgggtcagagctaaactccttcctggcctgagagtcagctctctgccctgtgtacttcccgggccagggctgcccctaatctctgtaggaaccgtggtatgtctgcatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaagg

SEQ ID NO: 311 - DNA, 355 bp, Homo sapien
  misc_feature (1)...(355): n = A,T,C or G
cctctctgtgctgctgaaggcagatcgcttgttccacaccagctaccactcccaggcagtgcatatccgcctgttgagaaatgccgtgtctagattgtggacaagagcctgcgtgattatgctatangganaaaaattcttcgagttccacccnanctcctctaaacatttggctcactcaaaacaaaaagncaccaatcttantactgctgaacttcatttatgtnacctaacattaaccntcgtaggaaaaccaaatagccctctcgtncangatatgttgctaaaggactaccntgttcaacacaacggctccggtgtgtgaactcctgtttgggtgattcccctactctca

SEQ ID NO: 312 - DNA, 498 bp, Homo sapien
ccattcttttgaatctaatctattatcaatagcatcctccataatatctttgataaaaggtgtccaccgagagagctgaaaagtttcttctgcagaccgatcctttcttaacggtttgccttgttgagattggggaacaatgggaacaccaaggtaactccagttacgaatcatgtcactctcattttctatctttacattctggatcaacctgtccaaattttcttccgtagttccattaatactgaagatataaagtagaattgctcttattttatcacaattatcatgatttttgttgagtagaactggaaggagtactcgcatggaatctttcaccttctgtccttctgcatcagttccaagtgccaggtcctgttcagttttgcagagcttttctatattaagcttgaacttattcatgcaatcttctgctaagttaagatggacaacttgcttagtaatctgttttcggaaatagggcatctttttcatcag

SEQ ID NO: 313 - DNA, 653 bp, Homo sapien
aaacttatcagatttttttaagttaggtaatttcaatccacagtggctccatatggttaaaaaaacaaaaacaaaaacgcatttaaggatacacgaagcagtgaaaacaaagccccagtattttcgctaaagtactggaaatacctgtttctaaaaacagctttatatttgtccactgcctagaatagctctcacccaaacctcaaaaataagagcagatagattttagaagcaagaaaaggtaaacagtgcccatattatttgagactggctctgctgccctccctaagccagtttacattctttgagattcttggagtgggtgagtcagggctgaagactgcacaggccatgtcccctgctccaactattcctcagaacgtcccaggtggagggagtggcctgtcgattttcactcattccatggagctctgtgtacatgaaaattcctccaagtgtggcttttgtcgaattcagagatacagcaagccacgcataaaacatggagtgtagagcactggtgtacctagcttagaaacaccctcggtgaatgtggtactgtggctcgaaaggaagcaagggacaggacccaggagactgggcggccaggctctcggagttccacacacacctgtgaagcccggccagcacag

SEQ ID NO: 314 - DNA, 513 bp, Homo sapien
ctggaagattttgctgcatttggcattatactgtaatttacagtatacaacatctggggactcagtactatcttagcacagactaacttctcccactccgtcagaggtggcaggtggcgggtcggtggggagggccttttctccccataaatgcctgaactttaatttataccatataagaaatcagtgaaaggtaaacaacaaggttaatgtaactctattataaattttgcattttttttctctgtgacatatacaagtatatttttgtttttggagctataaattatttaatttagcaatcttcaaagctcataaatttcaacttttcaaataagaaattttaacttcaaataagaagtctaggactttatggctattaattttactatcaaaatatccaagggactccattcaatgtaatagttataattcttctaaatatcatttgaataattctttgtggacgctagactcaagactatgctacatccaaacagtacatctataacc

SEQ ID NO: 315 - DNA, 222 bp, Homo sapien
  misc_feature (1)...(222): n = A,T,C or G
atttatattcaaggnatctcaaagaaagcattttcatttcactgcacatctagagaaaaacaaaaatagaaaattttctagtccatcctaatctgaatggtgctgtttctatattggtcattgccttgcaaacaggagctccacaaaagccaggaagagagactgcctccttggctgaaagagtcctttcaggaaggtggactgcattggtttgatatgttt

SEQ ID NO: 316 - DNA, 1633 bp, Homo sapiens
cgtggaggcagctagcgcgaggctggggagcgctgagccgcgcgtcgtgccctgcgctgcccagactagcgaacaatacagtcgggatggctaaaggtgaccccaagaaaccaaagggcaagacgtccgcttatgccttctttgtgcagacatgcagagaagaacataagaagaaaaacccagaggtccctgtcaattttgcggaattttccaagaagtgctctgagaggtggaagacggtgtccgggaaagagaaatccaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtcctgctaaagttgcccggaaaaaggtggaagaggaagatgaagaacaggaggaggaagaagaggaggaggaggaggaggaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatatttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttagaactcttctctactataacagtcaatttctgactcacagcagtgaacaaacccccactccgttgtatttggagactggcctccctataaatgtg

SEQ ID NO: 317 - DNA, 4235 bp, Homo sapiens
gaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcagtggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatgttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagtgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatatcttagactcgatgctgtataaaatattatgggaaaaaagaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacattatttcttggtttccacttgcaatggttaattaagtccaaaaacagctgtcagaacctcgagagcagaacatgagaaactcagagctctggaccgaaagcagaaagtttgccggaaaaaaaaagaccacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataagaaaactgaaatatgtcttcaaaaaaaaaaaaaaaaaaaaaaaaaaaaaaaaaaaaaaaaaa

SEQ ID NO: 318 - DNA, 3347 bp, Homo sapiens
atcccttggaggcattcatggctgaagtggaggatcaggcagctagagacatgaagaggcttgaagaaaaggacaaggaaagaaaaaacgtaaagggtattcgagatgacattgaagaggaagatgaccaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaaagaaagctaccaatcttcaaagagtctcttaccttgtgtttgatgaagcagatcgaatgtttgacatgggatttgagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagcccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgtgggtaagttgaggttatcttgggataaagggtcttctagggcacaaaactcactctaggtttatattgtatgtagcttatattttttactaaggtgtcaccttataagcatctataaattgacttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagaaacccaacaacagcttttaaagtgtcttctatctcattgtattttttttaacttgccccaatgatagaaaagtcttttgctgaaatgattttgatgatttttgtttatcgtttataaaaaggaaaagaaatatacaaactttgacttttgtgaaaaaaaaaaaaaaaaaaaaa

SEQ ID NO: 319 - DNA, 1814 bp, Homo sapiens
ggggagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaagctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggcgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagctt

SEQ ID NO: 320 - DNA, 3132 bp, Homo sapiens
ccgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaacggtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtatcccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaaaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttcttttttttttttgaaagtgttttttcttcgtccttttggtttaaaaagtttcacgtcttggtgccttttgtgtgatgccccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagtagctgcgattggg

SEQ ID NO: 321 - DNA, 2280 bp, Homo sapiens
ccgcccgccaccagctacgccccgtccgacgtgccctcgggggtcgcgctgttcctcaccatccctttcgccttcttcctgcccgagctgatatttgggttcttggtctggaccatggtagccgccacccacatagtataccccttgctgcaaggatgggtgatgtatgtctcgctcacctcgtttctcatctccttgatgttcctgttgtcttacttgtttggattttacaaaagatttgaatcctggagagttctggacagcctgtaccacgggaccactggcatcctgtacatgagcgctgccgtcctacaagtacatgccacgattgtttctgagaaactgctggacccaagaatttactacattaattcggcagcctcgttcttcgccttcatcgccacgctgctctacattctccatgccttcagcatctattaccactgatgcacaggcgccaggccaagggggaaatgctctttgaaagctccaattattggtccccaaaagcagcttccaacgtttgccatctggatgacaaacggaagatccactaaaacgtccacgggattaacagaacgtccttgcagactgagcgatgacaccacactttgtttggacatttaaattcactctgctgaataggaggaagcttttctttttcctgggaaaacaactgtctcttggaattatctgaccatgaacttgctcttctagacaactcacatcaaagccctcactccactaatggagaatcctagccccactaatgccaagtctgtttggggattttgcctcagctatgggcttccctagagtaggtctaggggaatactcagtctgatcttttttttgtttgttttattttgttttttttgagacggagtctcgctcttcctccaaggctggagtgcagtgacgcgatctccactcactgcaggctccgcctcccgggttcccgccattctcctgcctcagcctcccgagtagccgggactacaggcgcccaccaccatgcccggctaatttagttgtatttttagtagagatggggtttcaccgtattagccaggatggtctcgatctcctgacctcgtgatccgcccgcctcggcctcccaaagtgctgggattacaggcgtgagccaccgtgcccggcctgattctcttaaaattgaagaggtgctgccaaggccttcagatctaacgcagatgcatagaccttgttcctggtacttgttcagcctgtgctggggagccgtggtcccgagttccctgggaggctgacagggtcaagccaccctgcccaccaccctcccacttcccctcccctttcctctccagcattaggattcaagggaaatctgcatgaagccaattttgagggtagacgtgtggggaaaataaatcattatacagtaagacctggggcttgaggggtggggaatggggagggaagggcatagcctgctcctccatgagtctgacatctcggaaactgagcagctgccggacgcctgggtcaggaatccaagaccccacctcttaaggactggttcctcagaaagcaccctcagggaaaaaggtgaaaacattacatccgtggattctcctgccacaaccgcattggaagaaaaggctgccgcaacatctcagcgaggagtgaaggacccatgtcccaggaaccgcgctgcgccacctgcactcacccccctcacattctcttaagcacccggtggccctccgaggctggcggaatggtggtgcccacggggttgggcaagggctcaccaggacctcaacgggcaaagttgtgcacactaaaatatcaaatcaaggtgcttggttttaaagtaaatgtttttctaaagaaagctgtgttcttctgttgacccagacgaatagggcacagccctgtaactgcacgtgccttctgtcattgggaatgaaataaattattacgagaaagggacttgtcctaactggtttgaggccttacagttttgtatctacatttttcccctcctggggtttgcggggacagggacagaactacaggagtcatgggaaagaaaattctggcttcactactgctcactgctcactttctgatcactctgatactttttttttttttttttttttgcaacctgataccttgaaaagcttctatgtgtctctccttttgttgcctggcagctgtctaggatgatcactgattactatttactaagtagccacatgcaaataaaagttgtttggtaaaatggaaaaaaaaaaa

SEQ ID NO: 322 - DNA, 1398 bp, Homo sapiens
tagatggcaacctccctatctgcccgcaggtcatagaggcgacacgtagcgtcatctgaccctgaagcaaaggcatctccactccaaagttagacaaaatgccaggaatgttcttctctgctaacccaaaggaattgaaaggaaccactcattcacttctagacgacaaaatgcaaaaaaggaggccaaagacttttggaatggatatgaaagcatacctgagatctatgatcccacatctggaatctggaatgaaatcttccaagtccaaggatgtactttctgctgctgaagtaatgcaatggtctcaatctctggaaaaacttcttgccaaccaaactggtcaaaatgtctttggaagtttcctaaagtctgaattcagtgaggagaatattgagttctggctggcttgtgaagactataagaaaacagagtctgatcttttgccctgtaaagcagaagagatatataaagcatttgtgcattcagatgctgctaaacaaatcaatattgacttccgcactcgagaatctacagccaagaagattaaagcaccaacccccacgtgttttgatgaagcacaaaaagtcatatatactcttatggaaaaggactcttatcccaggttcctcaaatcagatatttacttaaatcttctaaatgacctgcaggctaatagcctaaagtgactggtccctggctgaagggaattaacagatagtatcaaggcacgaaggaatgtgccagtatggctccctgggtgaacagcttggccttttttgggtgtcttgacaggccaagaagaacaaatgactcagaatggattaacatgaaagttatccaggcgcagagttgaagaagcataagcaagacaaaaacagagagaccgcagaaggaggaagatactgtggtactgtcataaaaaacagtggagctctgtattagaaagcccctcagaactgggaaggccaggtaactctagttacacagaaactgtgactaaagtctatgaaactgattacaacaggctgtaagaatcaaagtcaactgacatctatgctacatattattatatagtttgtactgagctattgaagtcccattaacttaaagtatatgttttcaaattgccattgctactattgcttgtcggtgtattttattttattgtttttgactttggaagagatgaactgtgtatttaacttaagctattgctcttaaaaccagggatcagaatatatttgtaagttaaatcattggtgctaataataaatgtggattttgtattaaaatatatagaagcaatttctgtttacatgtccttgctacttttaaaaacttgcatttattcctcagattttaaaaataaataaataattcatttaaaaaaaaaaa

SEQ ID NO: 323 - DNA, 1316 bp, Homo sapiens
acttctacctgctcactcagaatcatttctgcaccaaccatggccacgtttgtggagctcagtaccaaagccaagatgcccattgtgggcctgggcacttggaagtctcctcttggcaaagtgaaagaagcagtgaaggtggccattgatgcaggatatcggcacattgactgtgcctatgtctatcagaatgaacatgaagtgggggaagccatccaagagaagatccaagagaaggctgtgaagcgggaggacctgttcatcgtcagcaagttgtggcccactttctttgagagaccccttgtgaggaaagcctttgagaagaccctcaaggacctgaagctgagctatctggacgtctatcttattcactggccacagggattcaagtctggggatgaccttttccccaaagatgataaaggtaatgccatcggtggaaaagcaacgttcttggatgcctgggaggccatggaggagctggtggatgaggggctggtgaaagcccttggggtctccaatttcagccacttccagatcgagaagctcttgaacaaacctggactgaaatataaaccagtgactaaccaggttgagtgtcacccatacctcacacaggagaaactgatccagtactgccactccaagggcatcaccgttacggcctacagccccctgggctctccggatagaccttgggccaagccagaagacccttccctgctggaggatcccaagattaaggagattgctgcaaagcacaaaaaaaccgcagcccaggttctgatccgtttccatatccagaggaatgtgattgtcatccccaagtctgtgacaccagcacgcattgttgagaacattcaggtctttgactttaaattgagtgatgaggagatggcaaccatactcagcttcaacagaaactggagggcctgtaacgtgttgcaatcctctcatttggaagactatcccttcaatgcagaatattgaggttgaatctcctggtgagattatacaggagattctctttcttcgctgaagtgtgactacctccactcatgtcccattttagccaagcttatttaagatcacagtgaacttagtcctgttatagacgagaatcgaggtgctgttttagacatttatttctgtatgttcaactaggatcagaatatcacagaaaagcatggcttgaataaggaaatgacaattttttccacttatctgatcagaacaaatgtttattaagcatcagaaactctgccaacactgaggatgtaaagatcaataaaacaaataataatcataaaaaaaaa

SEQ ID NO: 324 - protein, 200 aa, Homo sapiens
MAKGDPKKPKGKTSAYAFFVQTCREEHKKKNPEVPVNFAEFSKKCSERWKTVSGKEKSKFDEMAKADKVRYDREMKDYGPAKGGKKKKDPNAPKRPPSGFFLFCSEFRPKIKSTNPGISIGDVAKKLGEMWNNLNDSEKQPYITKAAKLKEKYEKDVADYKSKGKFDGAKGPAKVARKKVEEEDEEQEEEEEEEEEEEDE

SEQ ID NO: 325 - protein, 263 aa, Homo sapiens
MFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLNELVKHGLRALRETLPAEQDLTTKNVSIGIVGKDLEFTIYDDDDVSPFLEGLEERPQRKAQPAQPADEPAEKADEPMEH

SEQ ID NO: 326 - protein, 539 aa, Homo sapiens
MPENVAPRSGATAGAAGGRGKGAYQDRDKPAQIRFSNISAAKAVADAIRTSLGPKGMDKMIQDGKGDVTITNDGATILKQMQVLHPAARMLVELSKAQDIEAGDGTTSVVIIAGSLLDSCTKLLQKGIHPTIISESFQKALEKGIEILTDMSRPVELSDRETLLNSATTSLNSKVVSQYSSLLSPMSVNAVMKVIDPATATSVDLRDIKIVKKLGGTIDDCELVEGLVLTQKVSNSGITRVEKAKIGLIQFCLSAPKTDMDNQIVVSDYAQMDRVLREERAYILNLVKQIKKTGCNVLLIQKSILRDALSDLALHFLNKMKIMVIKDIEREDIEFICKTIGTKPVAHIDQFTADMLGSAELAEEVNLNGSGKLLKITGCASPGKTVTIVVRGSNKLVIEEAERSIHDALCVIRCLVKKRALIAGGGAPEIELALRLTEYSRTLSGMESYCVRAFADAMEVIPSTLAENAGLNPISTVTELRNRHAQGEKTAGINVRKGGISNILEELVVQPLLVSVSALTLATETVRSILKIDDVVNTR

SEQ ID NO: 327 - protein, 144 aa, Homo sapiens
MAFTFAAFCYMLALLLTAALIFFAIWHIIAFDELKTDYKNPIDQCNTLNPLVLPEYLIHAFFCVMFLCAAEWLTLGLNMPLLAYHIWRYMSRPVMSGPGLYDPTTIMNADILAYCQKEGWCKLAFYLLAFFYYLYGMIYVLVSS

SEQ ID NO: 328 - protein, 138 aa, Homo sapiens
MPNFSGNWKIIRSENFEELLKVLGVNVMLRKIAVAAASKPAVEIKQEGDTFYIKTSTTVRTTEINFKVGEEFEEQTVDGRPCKSLVKWESENKMVCEQKLLKGEGPKTSWTRELTNDGELILTMTADDVVCTRVYVRE

SEQ ID NO: 329 - protein, 346 aa, Homo sapiens
MFLSILVALCLWLHLALGVRGAPCEAVRIPMCRHMPWNITRMPNHLHHSTQENAILAIEQYEELVDVNCSAVLRFFFCAMYAPICTLEFLHDPIKPCKSVCQRARDDCEPLMKMYNHSWPESLACDELPVYDRGVCISPEAIVTDLPEDVKWIDITPDMMVQERPLDVDCKRLSPDRCKCKKVKPTLATYLSKNYSYVIHAKIKAVQRSGCNEVTTVVDVKEIFKSSSPIPRTQVPLITNSSCQCPHILPHQDVLIMCYEWRSRMMLLENCLVEKWRDQLSKRSIQWEERLQEQRRTVQDKKKTAGRTSRSNPPKPKGKPPAPKPASPKKNIKTRSAQKRTNPKRV

SEQ ID NO: 330 - protein, 826 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 331 - protein, 92 aa, Homo sapiens
MAYRGQGQKVQKVMVQPINLIFRYLQNRSRIQVWLYEQVNMRIEGCIIGFDEYMNLVLDDAEEIHSKTKSRKQLGRIMLKGDNITLLQSVSN

SEQ ID NO: 332 - protein, 235 aa, Homo sapiens
MDPARPLGLSILLLFLTEAALGDAAQEPTGNNAEICLLPLDYGPCRALLLRYYYDRYTQSCRQFLYGGCEGNANNFYTWEACDDACWRIEKVPKVCRLQVSVDDQCEGSTEKYFFNLSSMTCEKFFSGGCHRNRIENRFPDEATCMGFCAPKKIPSFCYSPKDEGLCSANVTRYYFNPRYRTCDAFTYTGCGGNDNNFVSREDCKRACAKALKKKKKMPKLRFASRIRKIRKKQF

SEQ ID NO: 333 - protein, 291 aa, Homo sapiens
MQRARPTLWAAALTLLVLLRGPPVARAGASSGGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 334 - protein, 582 aa, Homo sapiens
ESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSKTASKHVNKDLGNMEENKKLEENNHKTEA

SEQ ID NO: 335 - protein, 709 aa, Homo sapiens
MAEVEDQAARDMKRLEEKDKERKNVKGIRDDIEEEDDQEAYFRYMAENPTAGVVQEEEEDNLEYDSDGNPIAPTKKIIDPLPPIDHSEIDYPPFEKNFYNEHEEITNLTPQQLIDLRHKLNLRVSGAAPPRPGSSFAHFGFDEQLMHQIRKSEYTQPTPIQCQGVPVALSGRDMIGIAKTGSGKTAAFIWPMLIHIMDQKELEPGDGPIAVIVCPTRELCQQIHAECKRFGKAYNLRSVAVYGGGSMWEQAKALQEGAEIVVCTPGRLIDHVKKKATNLQRVSYLVFDEADRMFDMGFEYQVRSIASHVRPDRQTLLFSATFRKKIEKLARDILIDPIRVVQGDIGEANEDVTQIVEILHSGPSKWNWLTRRLVEFTSSGSVLLFVTKKANAEELANNLKQEGHNLGLLHGDMDQSERNKVISDFKKKDIPVLVATDVAARGLDIPSIKTVINYDVARDIDTHTHRIGRTGRAGEKGVAYTLLTPKDSNFAGDLVRNLEGANQHVSKELLDLAMQNAWFRKSRFKGGKGKKLNIGGGGLGYRERPGLGSENMDRGNNNVMSNYEAYKPSTGAMGDRLTAMKAAFQSQYKSHFVAASLSNQKAGSSAAGASGWTSAGSLNSVPTNSAQQGHNSPDSPVTSAAKGIPGFGNTGNISGAPVTYPSAGAQGVNNTASGNNSREGTGGSNGKRERYTENRGSSPSQSRRDWQSA

SEQ ID NO: 336 - protein, 480 aa, Homo sapiens
MIRAAPPPLFLLLLLLLLLVSWASRGEAAPDQDEIQRLPGLAKQPSFRQYSGYLKSSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 337 - protein, 543 aa, Homo sapiens
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDELTRHIRIHTGQKPFQCRICMRNFSRSDHLTTHIRTHTGEKPFACDICGRKFARSDERKRHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 338 - protein, 148 aa, Homo sapiens
PPATSYAPSDVPSGVALFLTIPFAFFLPELIFGFLVWTMVAATHIVYPLLQGWVMYVSLTSFLISLMFLLSYLFGFYKRFESWRVLDSLYHGTTGILYMSAAVLQVHATIVSEKLLDPRIYYINSAASFFAFIATLLYILHAFSIYYH

SEQ ID NO: 339 - protein, 196 aa, Homo sapiens
MPGMFFSANPKELKGTTHSLLDDKMQKRRPKTFGMDMKAYLRSMIPHLESGMKSSKSKDVLSAAEVMQWSQSLEKLLANQTGQNVFGSFLKSEFSEENIEFWLACEDYKKTESDLLPCKAEEIYKAFVHSDAAKQINIDFRTRESTAKKIKAPTPTCFDEAQKVIYTLMEKDSYPRFLKSDIYLNLLNDLQANSLK

SEQ ID NO: 340 - protein, 316 aa, Homo sapiens
MATFVELSTKAKMPIVGLGTWKSPLGKVKEAVKVAIDAGYRHIDCAYVYQNEHEVGEAIQEKIQEKAVKREDLFIVSKLWPTFFERPLVRKAFEKTLKDLKLSYLDVYLIHWPQGFKSGDDLFPKDDKGNAIGGKATFLDAWEAMEELVDEGLVKALGVSNFSHFQIEKLLNKPGLKYKPVTNQVECHPYLTQEKLIQYCHSKGITVTAYSPLGSPDRPWAKPEDPSLLEDPKIKEIAAKHKKTAAQVLIRFHIQRNVIVIPKSVTPARIVENIQVFDFKLSDEEMATILSFNRNWRACNVLQSSHLEDYPFNAEY

SEQ ID NO: 341 - DNA, 422 bp, Homo sapien
  misc_feature (1)...(422): n = A,T,C or G
gatganattnttncnagagagaggaagangctattcagttggatgggattaaatgcatcacaaataagagaacttagagagaagtcggaaaagtttgccttccaagcccgaagttaacagaatgatgaaacttatcatcaattcattgtataaaaataaagagattttcctgagagaactgatttcaaatgcttctgatgctttagataagataaggctaatatcactgactgatgaaaatgctctttctggaaatgaggaactaacagtcaaaattaagtgtgataaggagaagacctgctgcatgtcacagacaccggtgtaggaatgaccagagaagagttggttaaaaaccttggtaccatagccaaatctgggacaagcgagtttttaaacaaaatgactgaagcacaggaagatgg

SEQ ID NO: 342 - DNA, 472 bp, Homo sapien
  misc_feature (1)...(472): n = A,T,C or G
ctggagaaggtgtgcaggggaaaccctgctgatgtcaccgaggccaggttgtctttctactcgggacactcttcctttgggatgtactgcatggtgttcttggcgctgnatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcctcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctactgtgagtccag

SEQ ID NO: 343 - DNA, 139 bp, Homo sapien
gtcctgggccttccccttccctcaagccagggctcctcctcctgtcgtgggctcattgtgaccactggcctctctacagcacggcctgtggcctgttcaaggcagaaccacgacccttgactcccgggtggggaggtgg

SEQ ID NO: 344 - DNA, 235 bp, Homo sapien
ctgcgggctcagcacagtagacatgactgggatccccaccttggacaacctccagaagggagtccaatttgctctcaagtaccagtcgctgggccagtgtgtttacgtgcattgtaaggctgggcgctccaggagtgccactatggtggcagcatacctgattcaggtgcacaaatggagtccagaggaggctgtaagagccatcgccaagatccggtcatacatccacatcagg

SEQ ID NO: 345 - DNA, 458 bp, Homo sapien
ctgtaaggtgctattcagtcctgtgacccttattttggaatgctcttcattactgttgctctgttttgtgacttcctgggaaaccgcctactttggtgtggtgtcaccttgagctgtgcacataggacaccagttttgacttaacctaacaggcagtttttatctctagctttttcaagccaggtattgagcagtttcttggccaatggcctgagaaaccacctgtccctgtcaaggggtgattttattggttttaagtggggaagtaatcccatgtacttatttcttaaatacctaggaagttcttcttggtggctcctcttggccctcccctctttctcccccaacccaccatcctgcaaggcaaggaatggcctctccctccacagaggcaacggctgcagagggagcactgtggctgccatcccagttcctcttcaaagccaaacagacacgcg

SEQ ID NO: 346 - DNA, 525 bp, Homo sapien
  misc_feature (1)...(525): n = A,T,C or G
ccagagcacaacgcctcaccatggactggacctggaggatnntcttnnnggtggcagcagccacaggtgtccactcccaagcccaacttgtgcagtctggggctgaggagaagaagcctggggcctcagtgactatttcttgtaaggcttctggatatatncttactaaatatactttacattgggtgcgccaggccccccccggacaaagacctgaatgggtgggatggatcaacactggcattgataccgttaaatattcacagaagtttcaggacagagtctccattacctgggactcatccgcgaccacagnctacctgnanntgagtagcctggaatccgaagacacggctgtgtattactgtgcgagacttanggcccgttcgctgtggtgggacttaatgacgcttttgacatctggggccaagggacagtggtcaccgtctcttcanggagtgcattcgccccaacccttttccccctctctcctgtgaagaattccccgncggatacgagcagcgt

SEQ ID NO: 347 - DNA, 423 bp, Homo sapien
ccagacgctgacttgtttctgagtccttaagcaggaaggatttgaaatcctggagcttggcagtcttgctcttcacctctaagccaatgttgaccccttcatctataaagtccacaactctccggaagtcatcctcacggaactgtcgagaagttaaggctggggccccaagccgcaggccgcccggtgtgatggcacttcggtctccaggacaggtgttcttgttggcagtgatggatacaagctctagcacccgctcagcccgagctccatccaggcccttgggccgcaggtccaccagcaccaggtggttgtcagtaccacctgataccagtgagtagcctcgctctagcagggcatctgccatggcccgagcattcttcagaacctgcagggagtactcccggaacatgggggtgcagg

SEQ ID NO: 348 - DNA, 513 bp, Homo sapien
cctctaggcctgatgctctcagaggcaatagaagaaaagtaaaaggaaggtctcacttcacagacaatgaaaccctcctaaccctcttccccactacccacaactccctacactgccaatctaaataaaaagaggacaatgcatgagtgtgagatacacatacacacacacacatacacacacacacacgcacagcttcctttcagccaaagaactgcaaaatccttccccggaaggaggacaactggcaacaccaatcaaggcttggtggtctaaggtgatggctggaatcatgtgagactggtaaaaatccagggagaaaatgtttcaccttcagctcattcccaagtctctatgaagcccgccccacttccacataggggaactgtggctctgggggcagcctctgcagctactcagaataggtgggaggaggggctggctttgaggctgccttagccatgaggctctttgcctaggaatagctggagatgggagctgcagggggctcag

SEQ ID NO: 349 - DNA, 231 bp, Homo sapien
ccttatttctcttgtcctttcgtacagggaggaatttgaagtagatagaaaccgacctggattactccggtctgaactcagatcacgtaggactttaatcgttgaacaaacgaacctttaatagcggctgcaccatcgggatgtcctgatccaacatcgaggtcgtaaaccctattgttgatatggactctagagtaggattgcgctgttatccctagggtaacttgttcc

SEQ ID NO: 350 - DNA, 341 bp, Homo sapien
ctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacacccaagatctgctcttggaatgtggatgggcttcgagcctggattaagaagaaaggattagattgggtaaaggaagaagccccagatatactgtgccttcaagagaccaaatgttcagagaacaaactaccag

SEQ ID NO: 351 - DNA, 256 bp, Homo sapien
ggcgttggggacggttgtaggacgtggctctttattcgtgagttttccatttacctccgctgaacctagagcttcagacgccctatggcgtccgcctcgacccaaccggcggccttgagcgctgagcaagcaaaggtggtcctcgcggaggtgatccaggcgttctccgccccggagaatgcagtgcgcatggacgaggctcgggataacgcctgcaacgacatgggtaagatgctgcaattcgtgctgcccgtgg

SEQ ID NO: 352 - DNA, 368 bp, Homo sapien
  misc_feature (1)...(368): n = A,T,C or G
cctttcttgtaagtgaagaanaaggaatgcagcaaagaagagttcgacattggagtccttagttccatcaggatcccattcgcagcctttagcatcatgtagaagcaaactgcacctatggctgagataggtgcaatgacctacaagattttgtgttttctagctgtccaggaaaagccatcttcagtcttgctgacagtcaaagagcaagtgaaaccatttccagcctaaactacataaaagcagccgaaccaatgattaaagacctctaaggctccataatcatcattaaatatgcccaaactcattgtgactttttattttatatacaggattaaaatcaacattaaatcatcttatttacatgg

SEQ ID NO: 353 - DNA, 368 bp, Homo sapien
ctgaggggtggcagtaagcaatgaggatgggctataaagctgttaactggctaagggccatccttgggcaggcatttcagacacatctgtagagagggcagtagcatctccgataggccagctctgaaggaagcttaatgcttaatacagtcacactgcataaattagcttagaatgctctcttgggtaaaaaatattaatagtgtatatgcacttgaagagcaaaattcctcaagaaaaaaagtttaatagcaaggagtttccatcagtcccggtctttgtgaggattaccacaacaaacacttaaaaggatacaacaggtacttattaaatgctgccttgccttttacctcttccttttttttttt

SEQ ID NO: 354 - DNA, 380 bp, Homo sapien
ccatggcttctcacccagacagtctttctgggcaacttggggaagcccctgttctgctcaagtctcaccccatggaagaggtgggggaagggggccttggtttttcaggaagacaggttggagagcacgagtcactacaaagcagtaaaagtgaatggtgtctccaggggctgggtccagaacaccacggagagccccagccataaaggtgtgttccgcctctggcctgcaggaatctctttgaatctctttgattggtggctccaagagcaatgggaagtcaacagccaggaggctggactgggttccctgggaccccgaggtcccagagctgctgggcagtggttgtcggcaaagaagaaaggtccaagagggtcagg

SEQ ID NO: 355 - DNA, 347 bp, Homo sapien
ccagtggaggggtgggggtatcgatcccgccgggggctggcttggttgctggtgccctgagcccttctctgcccgcctgggtgttgccttcactgatggaggtaggcgtccagccagatgtcaccagacttcttcggggacctgacgatgtccaccagcgcggtgaggaagggcttcacttcgtagctgaggccgtgcttggcacacagcgacttgaccagcggggccacccggctgtagttgtgtctcggcatcctggggaagaggtggtgctcgatctggaagttgaggtgcccgctgaaccagttggtgaaaagtgagggctccacgttgcaggtggctgccag

SEQ ID NO: 356 - DNA, 157 bp, Homo sapien
cctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccag

SEQ ID NO: 357 - DNA, 323 bp, Homo sapien
ccatacagggctgttgcccaggccctagaggtcactcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctgg

SEQ ID NO: 358 - DNA, 555 bp, Homo sapien
aaaaggtttctaaaacatgacggaggttgagatgaagcttcttcatggagtaaaaaatgtatttaaaagaaaattgagagaaaggactacagagccccgagttaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaccac

SEQ ID NO: 359 - DNA, 549 bp, Homo sapien
ctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctcttgctgcttgagagctattgctttggt

SEQ ID NO: 360 - DNA, 289 bp, Homo sapien
tttaaattttactagtgttacttaatgtatattctaaaaagagaatgcagtaactaatgccctaaatgtttgatctctgtttgtcattactttttcaaaattatttttttctgtaaagtataatatataaaacttcttgcttaaattgaatttctatattagtggttaattgcagtttattaaagggatcattatcagtaatttcatagcaactgttctagtgttttgtgtttttaaaacagaattaggaatttgagatatctgattatatttttcatatgaatcacag

SEQ ID NO: 361 - DNA, 311 bp, Homo sapien
ctgttcagtatggcaaagggcagacttactccttcatccactctgctgccttgatgaggtgaacacactggaataagatggagggcaggatacctgccaaagcctgaggaatgagatgatctgaaacaattgggcaaaggctggacatttcaaaaagctgacttccaactgcagtttatgggtatagaatttgatgcttccctcaagtcctgactgctctttctgaggcagccaggctaggccaagaaatgagctgctccagcttctccagagcacagcagcctcccagggcctgtcagcatctgcagcag

SEQ ID NO: 362 - DNA, 496 bp, Homo sapien
  misc_feature (1)...(496): n = A,T,C or G
ccagtttctaaaanaatgcacatttaaagagaagcatctaccacggctttaaaacaaaacaactctgagatgaacaatatgtgttatactcagagattaacaatctcaatcatacatactgattctttcagacatttaataaccactacatttttttgcattaatgaagtttgactatatgtgtaaagggactaaatatttttgcaacagcctgttctttgttcattcttttctggatagcgtgtcctctgtattgcggtagatttatacattctgttgcctaaatatgtgtgtaaaatgagctgataaactggagtactacttaaaaaaaagtctgtgatttataagatgcatatgctttctatgtgaatataagcttgtgcacaatgtttaaaagaaaaacaatgaattagaagagatcccccgtcccccagtctgacatatttcatacagaatgtttaaaagaaaaactctgctagtcttggcaaacatttgg

SEQ ID NO: 363 - DNA, 673 bp, Homo sapien
  misc_feature (1)...(673): n = A,T,C or G
ccaagagggagataanacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggctttgtgcatagtgtcttcatgtcgcgtatagttgagcgcgttcttagcagttggcttcatggacagctcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgcgcaaagcttaacaatttgtaggaaactttggg

SEQ ID NO: 364 - DNA, 495 bp, Homo sapien
  misc_feature (1)...(495): n = A,T,C or G
ccaaatgtttgcncaagactagcagagtttttcttttaaacattctgtatgaaatatgtcagactgggggacgggggatctcttctaattcattgtttttcttttaaacattgtgcacaagcttatattcacatagaaagcatatacatcttataaatcacagacttttttttaagtagtactccagtttatcagctcattttacacacatatttaggcaacagaatgtataaatctaccgcaatacagaggacacactatccagaaaagaatgaacaaagaacaggctgttgcaaaaatatttagtccctttacacatatagtcaaacttcattaatgcaaaaaatgtagtggttattaaatgtctgaaagaatcagtatgtatgattgagattgttaatctctgagtataacacatattgttcatctcagagttgttttgttttaaagccgtggtagatgcttctctttaaatgtgcattttttagaaactgg

SEQ ID NO: 365 - DNA, 291 bp, Homo sapien
aactgacaagcccttgcgcctgcctctccaggatgtctacaaaattggtggtattggtactgttcctgttggcccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcag

SEQ ID NO: 366 - DNA, 277 bp, Homo sapien
ctggatggtgcctcagaaggtgcattctgcttctgcaggggcttgaaacaccaaggcactccagggatcctggagtcaaagcagcagccccggttgttgcactccttgggggtgacatgggggtagcccgcagtccaccctgtccttggctggcacggcacactggtttgcagacaggcccacgtactcctcagcagagctggaggacaagcaaggccaggaccagccccagcatgcagagcgctctggcagccatgaccaccgtgggctccgggac

SEQ ID NO: 367 - DNA, 311 bp, Homo sapien
ccagagctgcggggcctcagtacacggagctgttccggatgccacagcacagcaccatgctcaggatcatctcgaagatcatgatcacagcgaccacgatggcagcaatgccgatgaggtacagcttcccggagaagaggtcatcgatcttctggtggcagtcctccttgaagaggttgctgatgatgttgctgcccgagggacacaaattgttcttgagcactgaggtggtcaaagcagtcagtgtgctggagccacagcagtcaagcgtctcgtggaaggtcttcaccacagccttggcgttgttggcg

SEQ ID NO: 368 - DNA, 384 bp, Homo sapien
ccaaaggggtctctagctgctgctctgctgctcctgctcatggatgagtttggcgatggggccggtgatgccgcctatcaaggtccagtactcatcgaagctgatgcgcccatcaggattggcatccaggttctggatgagcttatccgcagccttccggttccctgtgtccgacagcatgtggttcagctctttctggagcatctcgcggaagctgctcttgctgatcttgttcttgaccaggctgtacctagacacatatttgtagaagttttccaccaggacaatgactgccttctccagctccgtgtagcaagtctgacatctccctgcttcgcctgctggcggggcctaaggcgggggccaagcccagttacagcccag

SEQ ID NO: 369 - DNA, 216 bp, Homo sapien
ccaagtgccaggtggctttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcag

SEQ ID NO: 370 - DNA, 561 bp, Homo sapien
ctggctccttcttttgtggtcgtttgggggatgggctggtttggggtttaggtgcagagaatggtttggggccactgcgtactggaccactctgagccttcagggcagggttcttgtgagtcttcatgtcatcagatacatgtttcagggcatgtgtaatgctctccccctgattaatctgcgcgaacagtgctgagcgggaagcagactcatctgagcctgaactggtagagactgggggaggaggggggcctggtggagggggaggaggacctgatccggcagagggtccagatggcagtccgctcagttcttttgccacaggccccgttttgctccaggccagtccggtggtatggaactccttaatgtaagcctgcagctctgtccatatacttaaataagctttgacccagtctacatgcttcttatccacatctttgtactctttgaggactcggtttgtataaaacatggcggcatcattcatttctttcgcataagggccaggcttgggagccatagccacccagcccagggcctggatactttcgctgacag

SEQ ID NO: 371 - DNA, 518 bp, Homo sapien
cccacttccatcgctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcag

SEQ ID NO: 372 - DNA, 335 bp, Homo sapien
ctggaggctgggtgcaccctgcccagatccacacctgtaccccggcggaaaggctcatgggcattgaagacggtggtgaaaaagccaaagggaaaagcaccaacaccaaatgagaagtggaagcccccggtatcaccaaatggctggaatccccctctgctctccggagctggtctctggccctgggggcggggtggagtttttaatctgggatcctggggcttctggctccctcgcccataaagcgggacaaccttctctctgctgatcccagctttacatactggacactcttgccgttctggccgtgtctccagccactgatgaagacatgg

SEQ ID NO: 373 - DNA, 467 bp, Homo sapien
ccactagctgaatcttgacatggaaggttttagctaatgccaagtggagatgcagaaaatgctaagttgacttaggggctgtgcacaggaactaaaaggcaggaaagtactaaatattgctgagagcatccaccccaggaaggactttaccttccaggagctccaaactggcaccacccccagtgctcacatggctgactttatcctccgtgttccatttggcacagcaagtggcagtgtctccaccacctatgatggtgatgcagcccctagaagtggctttcaccacctcatccatgagagctttggttccccgggcaaaagcttcccattcaaatacccccacaggaccattccacacaatctgcttagcccgagtgacagcctcagcatacttcttgctgctttcaggaccacagtccaagcccatccagccagcaggtacgccagaagccacagtggcttgg

SEQ ID NO: 374 - DNA, 284 bp, Homo sapien
tttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttgg

SEQ ID NO: 375 - DNA, 307 bp, Homo sapien
cctactcttctccgtccattgtactatctgcccgtggtggggatggcagtaggatcatatttgatgacttccgagaagcatattattggctccgtcataatactccagaggatgcgaaggtcatgtcctggtgggattatggctatcagattacagctatggcaaaccgaacaattttagtggacaataacacatggaataatacccatatttctcgagtagggcaggcaatggcgtccacagaggaaaaagcctatgagatcatgagggagctcgatgtcagctatgtgctggtcatttttggagg

SEQ ID NO: 376 - DNA, 650 bp, Homo sapien
  misc_feature (1)...(650): n = A,T,C or G
ccattgnctnctnacgtgatgtcatcatctgccaggtcatcttggcaaaagtcggagcatttctcagtcactgcaaagtagcccttctcgttggagcaccggaagagacgtgtgtgtttcatgtactcggcatcgtcatcatagggcttctgtgccccaatgcccacccagaagaagttctcaggctcctcaccttcgttgataacctgcttgctgtaggaggtgtcaaacatggtgttcaggatgtcttctgccaacttggcttcgtcagggtctgatgcccggcccacccaggcatacacgatgccctggttgtcctcactctcaaagggaaccttgaggatgaagcagaactcggagttgaggaggctggagtcggtgttgatctggatgcaccgggtgcagagggcgctgccgttggtgcggatctggtagaggctgggctgttgggcgccctggaccgccttcctcttgccccggtggatgatgaacttcctcttgaaatgggacaggaacttggggttctcctgctgctgcgtcatgcgtaccacctccagcttcccagggaagaggctctcgaacttcttttgcaggctgaaggtgaaggtgacccacccatattgggaggctttcacggccctgccagaagt

SEQ ID NO: 377 - DNA, 306 bp, Homo sapien
  misc_feature (1)...(306): n = A,T,C or G
tctagatgcatgctcgagcggccgccagtgtgatgganatctgcagaattcgcccttcgagcggccgcccgggcaggttcgggtgctgccttcacctgccaggcccttccccgctagcttggggcgagcagagctgcgtccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcga

SEQ ID NO: 378 - DNA, 199 bp, Homo sapien
  misc_feature (1)...(199): n = A,T,C or G
ccacangtggcacttgggtgtggctcctctgttatttgtcctcatgtgagaaagcagatcatctccaaatcttgccatttgtatacttttggtggagacttggatgtcatatcttctttgttttgggttttcttccctagcttattttgtggcttttaaagaagtggattgtattgtgagatcctgtgattcctggtgg

SEQ ID NO: 379 - DNA, 216 bp, Homo sapien
  misc_feature (1)...(216): n = A,T,C or G
ccagggcangtcatcaagaggggcattgtcttgcatgcggcctgccgtgtccaccagcaccacgtcaaagccttggttacgtgcaaaagcaatggcttccatggcaatgccagcagcatccttgccatagcccttttcaaacaactgcaccatggtgcggccaccatgcttctctggagggtgtagggcactcaaacgccgggtgtgtgtacgcag

SEQ ID NO: 380 - DNA, 555 bp, Homo sapien
ccatgggccttcctttccactaaaaggaattccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcagggtcagagaagattcttcatgggaaatcaagttctaaaggctttgccccaagagatgatgaggcag

SEQ ID NO: 381 - DNA, 406 bp, Homo sapien
ctgcaccaggtgggcctctaggtcccattaagcccattggtccagggccaagtccaactccttttccatcatactgagcagcaaagttcccaccgagaccaggggggccaggaggaccaggtggaccaggagggcctgtgggaccatcttcaccatctctgcctggggggcctggtggacccctttctccacgtggtcctctatctccggctgggccctttcttacagtttcctcttgtaaagattggcatgttgctaggcataaggttactgcaagcagcaacaaagtccgcgtatccacaaagctgagcatgtctagcacttagacatgcagactccttgtgtcgcagagcccctgggtcaccggcggaggtatcacctggcgggcgcgggcatgcagtcgtgg

SEQ ID NO: 382 - DNA, 528 bp, Homo sapien
  misc_feature (1)...(528): n = A,T,C or G
ctgagcagtttgtgggtntntcttcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagaccaacagacttcagaccctcagacctgccccggggccaggtggagaaagtgagggccgtacaaggaagtgaaattctgagttgttggggctaagcctgaccccctctccatgctccccgccccaacccactctggcctcagtagatttttttttcagttgtggttgttgcccaggctggagtgcagtagcgccatcttggctcactgcacctccaccttccgggctcaagcgattctccagcctcagcctcctgagtagctaggactgcaggtgctccaccacgcccggctaatttttgtatttttagtagagatggggtttccccatgttgg

SEQ ID NO: 383 - DNA, 335 bp, Homo sapien
  misc_feature (1)...(335): n = A,T,C or G
ccatnttgagtctactcctgcgtcttgtgccctagcaccccgagaaccgtcagtttgagccagatggaagctgagctgaacacattacgatggatgatggaaacataagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattcatgtggcgaaaaaaaaaaaanaaaaaaaaaaaaaa

SEQ ID NO: 384 - DNA, 333 bp, Homo sapien
agtccaatacggctattggggttgtagcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaagg

SEQ ID NO: 385 - DNA, 343 bp, Homo sapien
ctgtgacacctcaggttgaaagggtcttcctccttgaacacccaccgaggggcctggagcaacagccagccgatatggacttctagctgcaccgggtcactgagggtggagaggtttgtctggcacctgtactctccactgtcgtcgactgtggcagcgtcaatgaagtagctcgaggcctggcttgagatgaggctctcattgtgaaaccactgtgtggaattgtcctcaggggagtaggctccctggcacttcagagtcacactgtccttctcgagcaccctgtaccattgaggctccaggaacaccacagcctttgggagatcttcagtccgcatgccaa

SEQ ID NO: 386 - DNA, 244 bp, Homo sapien
tattctttgattcttggcaaataggtgagagaactaatagcaaccaggcaactgaggacgaagtcaaaaagtcggtaacagaagaatggaatcagccaacccacttgataagaaattgctccataaaccagcattgaactgattataaacataagaacagagacggcaaaaagaacacaggcattatcagccattctctcagacgaatagtaattaccgatgacttcatactgaatgttgacag

SEQ ID NO: 387 - DNA, 504 bp, Homo sapien
atctggagtccagcctcagggatgcgctactttccattctctgcattgaacattcgttctgtcagcatccgctccagcttcactgcatcagcggcaaacttgcggatcccgtcagagagcttctccacagccatctggtcctcgttgtgcaaccaacggaaagacttctcatccaggtggattttttccaggtcactggcttgggccgccttggctgagagcacaggcaccagcttggcgttgtcctgcagcagctctcccaggagcttgggtgggatggtgaggaagtcacagccggccagtgctttgatctcgcccgtgttgcggaaggaggcgcccatgacaatggttttgtagctaaacttcttgtagtagttgtagattttagtgacactctttaccccagggtcttccaggggctcataggatttcttgtcggtgtttgccacatgccaatcaaggatgcgcccaacaaatggggagatgagggtcacacccgcctcg

SEQ ID NO: 388 - DNA, 450 bp, Homo sapien
  misc_feature (1)...(450): n = A,T,C or G
gccaaagtgctgcntgaattccactcccttggttttcgcctgcccagcgttgctgtttgcgtggagggtggggggagctcagtggcagggaatcagcggtccgtggggtcgtggggacgggaacatgtgcccgaccgctccatcccctcctcctccttaggatgcataacctaccttgtctttttttttttaaattttntttccaggtanagtagctntttgtacataaanaatacttgaaaaattaattgtatgatgtatgaaaanacanagtctcctagttttgtatnttgttgtatgactgccatgagttccaccaaaaagccactntattttggtctntgtgacattttaaatgcgtgacaaaagtgagcaaataaagngaggaanaaatntatntatganataatatanattgtattgaaatctaaaaaaaaaaaaaaaaaaaaa

SEQ ID NO: 389 - DNA, 297 bp, Homo sapien
cctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggagg

SEQ ID NO: 390 - DNA, 223 bp, Homo sapien
ctgggctggagagttggtgctggcaaaacagtccttcccctggggccggttcttacccaggtccagagaaaccaacgcgggatgtcagacttcaccaaaaggactttctggttgcccctggctggcttcctggaggcgttcgcctctagtttctcagggatggagcgagagcccagccagagaacagtaagaggagctgctctcctatctgcactcacccagg

SEQ ID NO: 391 - DNA, 365 bp, Homo sapien
ctgaggaagaaatgaaaaaagaccctgtccctcatggcccgcccactggcctcctgtgaactctgtcctgttgccaaccccagatgaagtcagccaaaaagtgctttccacatcctctctctggggctgcccagcctgaccgtaggggatccactggcagagccaaggtggatgctggtgcctgaagctggaagccagcaggacatgagacccctcctgtagcaggaagtggttctagaactcccagcagaacagaacggaaaaggagctgattggggatagaatgagttctgctaaacagccagatgctctgagagaggtgacactggactgtctcggaggtgtgtgcagatggctacaggtgg

SEQ ID NO: 392 - DNA, 302 bp, Homo sapien
  misc_feature (1)...(302): n = A,T,C or G
ccaagagctacaatgagcagcgcatcangacagaacgtgcaggtttttgagttccagttgactgcagaggacatgaaagccatagatggcctagacagaaatctccactattttaacagtgatagttttgctagccaccctaattatccatattcagatgaatattaacatggagagctttgcctgatgtctaccagaagccctgtgtgtggatggtgacgcagaggacgtctctatgccggtgactggacatatcacctctacttaaatccgtcctgtttagcgacttcagtcaactacag

SEQ ID NO: 393 - DNA, 213 bp, Homo sapien
  misc_feature (1)...(213): n = A,T,C or G
ccaataatcaagnacaaanactggatttgaggatggatcagttctgaaacagtttctttctgaaacagagaaaatgtcccctgaagacagagcaaaatgctttggaaagaatgaggccatacaggcagcccatgatgccgtggcacaggaaggccaatgtcgggtagatgacaaggtgaatttccattttattctgtttaacaacgtggatgg

SEQ ID NO: 394 - DNA, 334 bp, Homo sapien
cctacccataatccagagaggcttgcccagaggaggactacgtgggggacgtgccaccagaaccctacttgggggcgggatgtcactccgaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggtcggggtatgataggtcggggaagagggggctttggaggccgaggccgaggccgtggacgagggagaggtgcccttgctcgccctgtattgaccaaggagcag

SEQ ID NO: 395 - DNA, 174 bp, Homo sapien
ccagatgaggaaaaaaattaggaaggagatgaagttttccaaatttcatggtatatgctgcacttccccaaccttcactctccatgtagcctactgggtctactattccacaaagtggctcaacctccaaatgacctctggtttacccctattaaaatcccaaaggactttcag

SEQ ID NO: 396 - DNA, 140 bp, Homo sapien
  misc_feature (1)...(140): n = A,T,C or G
ctgcaaagccttgtgtaacnttctccagcatttggacccagtacgtgaaagcccacaacacgttcattgtctttagtattacagattatttttgcataacatttgttgttatctcttgacggaatcgtccattccaatgg

SEQ ID NO: 397 - DNA, 318 bp, Homo sapien
cctcgcctggagggcccccgggcagcacagggaggacgagcttgtccagcagagggtctggcagagggtcccgcagaggtttgggcagggggtctgacatccctggctcctgctctggctctggctgccgggatttgcacaggcccaggtgcatacagatgccgtttgagtcagtctggttctggaagtagtcgatgaccagggggaagtagtcgtcaagcacttggttgcactggggcatgagcagcttcaaggggaggacgttgcactcctgctccaggaacttcctcatcgtgtcctggaaaatggcctccttgg

SEQ ID NO: 398 - DNA, 517 bp, Homo sapien
  misc_feature (1)...(517): n = A,T,C or G
ccttncttcgccatccattcatcgaccctctccagcacttgctgcaggcttggctgaccatccaccatggcttgaataatcccggtgagctctgtacagaatggggtaagctgtggatggactacaggctggacatacatgtgaaaggtagactcaatctccatggtccggccatttagctttaggatggggaactcgatgatttcctgaggatgaatctgtggcttgtcgcacgtggcctcaaagtccagcactaaaaagtagtgatacctctggagagggaaggacaccattgccgccatggatgcgccaaagccgtgggccgccagctttctggtggatatggagcagaactccggaacaccacagggagaaaataagtgggagcccagcacttttcttgctcttgaaagtaaatacgaagaaaatcgagctgctccagtctgtaaaggtgctagcattgaacatccagaagcatctaaaactctccttacttcgaagatgccaagaccggcag

SEQ ID NO: 399 - DNA, 329 bp, Homo sapien
ccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttccttttttcggtaacaagacttagaaggagggcccaggcactttctgtttgaacccctgtcatgatcacagtgtcagagacgcg

SEQ ID NO: 400 - DNA, 451 bp, Homo sapien
ctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaagctgctggagctggcaaggtcaccaagtctgcccagaaagctcagaagctaaatgaatattatccctaatacctgccaccccactcttaatcagtggtggaagaacggctcagaactgtttgtttcaattgg

SEQ ID NO: 401 - DNA, 180 bp, Homo sapien
ccaggaagcaggccaggggattggcagcactgcccagcaccacagccaggtggtaggccagacgcccgtagggtaagcaggaaaagctctgcacggcaggcagcacgccattggtcagcgcgttggtggcggccaacaggcccagcaggcaggcactgcgggctgatagaagctgatagg

SEQ ID NO: 402 - DNA, 385 bp, Homo sapien
ccaggccacctgtgcggggctcctcgatgtggaaggttcgggtgaggagattgtagaaggagccgtagcacacggccaccacagtgcacgtgaggcagatcacgttgtagggcatgctgaagtccggtgtcggcaggttcaccagcagcggctccgtgtagagccgcacaaagtagttagagccatcagagactgggaacaggctgttgaagaggggactctcttcccagtccactggcttggctgctaccatgctgggcacaagggcgctgaggacagatgggctgacatagaagccatggttaggatctggcgtgtactcggtccacttcagcagcgcccgctcaaactggatggaaaccttggtgactgagttggccggcag

SEQ ID NO: 403 - DNA, 440 bp, Homo sapien
  misc_feature (1)...(440): n = A,T,C or G
ctgtttaaccagnaacccggggggtcaccccccacagaatgtacatgaaacactagaggactgcatgtttttccctgagagaagcgtaagacaaacagaagtcaaaaagtagtcactgggagcgccatccttctaagcaaatcctccctttcccttttggaggatttgcccgaactacgtagccagtcagcacttagaccacctgcctcctcccccccctataaacccaccactcccctcctcctttcccaaaccacttggggtgtcctaagccctcactgccccaagcccaaaatatcagctaagatccttgtcagtatttccacagtcatacctaatgaattgggaagtggggcccctaaaaaccaattcacatctatgcacttgtttccactggatttggcagacaggcttttttagttaccgtaaccagatcttaa

SEQ ID NO: 404 - DNA, 239 bp, Homo sapien
cctacgaaaaactcccggccggtgaagagaacgtcagtgccatccagcgtcgcgttctcgtctcctatttccacaattcggagccccaggtcttgcagggctttgcggactccatcgacctctggcctacgagcggggctccagggccgcgtgattagggccgtgtccccttggatcacggccgtgtcgccaagcagcggtcccagcggcaatgactcctcaggtggcagttctagcag

SEQ ID NO: 405 - DNA, 261 bp, Homo sapien
ctggagaggcagcccttcaccggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcag

SEQ ID NO: 406 - DNA, 641 bp, Homo sapien
  misc_feature (1)...(641): n = A,T,C or G
ctgctcccgggcntggtggcagcaagtagacatcgggcctgtgcagggccacccccttgggccgggagatggtctgcttcagtggcgagggcaggtctgtgtgggtcacggtgcacgtgaacctctccccggaattccagtcatcctcgcagatgctggcctcacccacggcgctgaaagtggcattggggtggctctcggagatgttggtgtgggttttcacagcttcgccattctggcgggtccaggagatggtcacgctgtcataggtggtcaggtctgtgaccaggcaggtcaacttggtggacttggtgaggaagatgctggcaaaggatggggggatggcgaagacccggatggctgtgtcttgatcggggacacacatggaggacgcattctgctggaaggtcaggcccctgtgatccacgcggcaggtgaacatgctctggctgagccagtcgctctctttgatggtcagtgtgctggtcaccttgtaggtcgtgggcccagactctttggcctcagcctgcacctggtccgtggtgacgccagaccccacctgcttcccctcgcgcagccaggacacctgaatctgccggggactgaaacccgtggcctggcagatgagcttggacttgcgg

SEQ ID NO: 407 - DNA, 173 bp, Homo sapien
ccaggtactggcacaatcatgtctggatgggggtggtggtgtcctgtaggcagagaaacaggaaattgtcgtagtcagtatcgagcagcgtggcctcgttcgccaccgtatagttgatcttgaacttctttggattctcagtcttctctccaaggaccttcttctcaacacag

SEQ ID NO: 408 - DNA, 165 bp, Homo sapien
ccactgtctgcagccatggcagaaagtgctcaaagtccagcaccttcacattcatctcatcactcttggggttccccaggaccttgagcacctcggcgttggtagggttctggcccagggccctcatcacatccccacactggctgtacaggatcttgccatcac

SEQ ID NO: 409 - DNA, 329 bp, Homo sapien
ctgtagcttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacctatgagacacaccagtgtggccttgttggcttgaagctcctcagaggagggcgggaacagagtgaccgagggggcagccttgggctgaccaaggacggtcagcttggtccctccgccaaataccgccggataagcaccactgttgtctgctgattgacagaa

SEQ ID NO: 410 - DNA, 235 bp, Homo sapien
  misc_feature (1)...(235): n = A,T,C or G
ccatcagngagaaaggtgtttgtcagttgtttcacaaaccagattgaggaggacaaactgctctgccaatttctggatttctttattttcagcaaacactttctttaaagcttgactgtgtgggcactcatccaagtgatgaataatcatcaagggtttgttgcttgtcttggatttatatagagctttttcatatgtctgagtccagatgagttggtcaccccaacctctggag

SEQ ID NO: 411 - DNA, 294 bp, Homo sapien
aattaagggaagatgaagatgataaaacagttttggatcttgctgtggttttgtttgaaacagcaacgcttcggtcagggtatcttttaccagacactaaagcatatggagatagaatagaaagaatgcttcgcctcagtttgaacattgaccctgatgcaaaggtggaagaagagcctgaagaagaacctgaagagacagcagaagacacaacagaagacacagagcaagacgaagatgaagaaatggatgtgggaacagatgaagaagaagaaacagcaaaggaatctacag

SEQ ID NO: 412 - DNA, 433 bp, Homo sapien
  misc_feature (1)...(433): n = A,T,C or G
cctgagaagccagaggcaggtggagagggggtggaaagtgagcagcgggctgggctggagccgcacacgctctcctcccatgttaaatagcacctttagaaaaattcacaagtccccatccacaaaaaaaaaaanaanaaaaatttcagggantaaaaatanactttgaacaaaaaggaacatttgntggcctgggggggcatctnantttntntagcnccagngattccctccccnccccacccatcacatanatgtaacacctttggtntaaaatggggagccgtttccaccntgcccccntccccgcccccaggcagttgccccggngacacntcaagacaggancgaggtagtntttcancancacagttncacaaggaacagaacagtntctcccgcccagccctgcggcacaagggattgacacgcn

SEQ ID NO: 413 - DNA, 494 bp, Homo sapien
  misc_feature (1)...(494): n = A,T,C or G
ccttatttctcttgtcncttcgtacagggaggaatttgaagtagatagaaaccgacctggattactccggtctgaactcagatcacgtaggactttaatcgttgaacaaacgaacctttaatagcggctgcaccatcgggatgtcctgatccaacatcgaggtcgtaaaccctattgttgatatggactctagaataggattgcgctgttatccctagggtaacttgttccgttggtcaagttattggatcaattgagtatagtagttcgctttgactggtgaagtcttagcatgtactgctcggaggttgggttctgctccgaggtcgccccaaccgaaatttttaatgcaggtttggtagtttaggacctgtgggtttgttaggtactgtttgcattaataaattaaagctccatagggtcttctcgtcttgctgtgttatgcccgcctcttcacgggcaggtcaatttcactggttaaaagtaagagacag

SEQ ID NO: 414 - DNA, 294 bp, Homo sapien
ctgggcggatagcaccgggcatattttggaatggatgaggtctggcaccctgagcagtccagcgaggacttggtcttagttgagcaatttggctaggaggatagtatgcagcacggttctgagtctgtgggatagctgccatgaagtaacctgaaggaggtgctggctggtaggggttgattacagggttgggaacagctcgtacacctgccattctctgcatatactggttagtgaggtgagcctggcgctcttctttgcgctgagctaaagctacatacaatggccttgtgg

SEQ ID NO: 415 - DNA, 421 bp, Homo sapien
ccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacag

SEQ ID NO: 416 - DNA, 342 bp, Homo sapien
  misc_feature (1)...(342): n = A,T,C or G
ccactttctttcccacnctggaaggcggcatctatgacttcattggggagttcatgaaggccagcgtggatgtggcagacctgataggtctaaaccttgtcatgtcccggaatgccggcaagggagagtacaagatcatggttgctgccctgggctgggccactgctgagcttattatgtcccgctgcactcccctatgggtcggagcccggggcattgagtttgactggaagtacatccagatgagcatagactccaacatcagtctggtccattacatcgtcgcgtctgctcaggtctggatgataacacgctatgatctgtaccacaccttccggccgg

SEQ ID NO: 417 - DNA, 389 bp, Homo sapien
tattaattaggttcttaagacatttagaacaccaatttgtgaggataaattccattcgtcagagcaaacacagatcgcaggtagccctggagctgaggaatagctttgatttttggtaaaatttgtgagtccacagctttctgatcaatcttgcgctgctccgtaatctcatatttctctttttctgtgtcgaagatctcaccttcctggtgtctgggcttccgcagcttcttcttcttgaagtaagcatcagtaagatgttttgggatttttacattgctgatatcgattttggttgaagtggcaatgacaaatttctggtgtgttcttcgtagaggaactcgattgaggaccagaggtccagtcacaagtaataagccactagccag

SEQ ID NO: 418 - DNA, 343 bp, Homo sapien
gtgggagggagccaggttgggatggagggagtttacaggaagcagacagggccaacgtcgaagccgaattcctggtctggggcaccaacgtccaagggggccacatcgatgatgggcaggcgggaggtcttggtggttttgtattcaatcactgtcttgccccaggctccggtgtgactcgtgcagccatcgacagtgacgctgtaggtgaagcggctgttgccctcggcgcggatctcgatctcgttggagccctggaggagcagggccttcttgaggttgccagtctgctggtccatgtaggccacgctgtttttgcagtggtaggtgatgttctgggagg

SEQ ID NO: 419 - DNA, 255 bp, Homo sapien
cctagcaagagaatcaccaaatttatggagagttaacaggggtttaacaggaaggaagtgcctttagtaagttctcaagccagaggctggaggcagcagctaaatcagaggacagcatcctcagtgaaagtgagccattcggggtggcatgtcactccaggaataaacacaacttagaaacaaatgatttcgtaggatagcacagtgacatggtgcactgtgaacctgaggccactgtgtcaaactgtgcactgg

SEQ ID NO: 420 - DNA, 261 bp, Homo sapien
cttctgatgataaccaacccctagctaccactctgtattcatcaggggaggggtataaaccccacatgcaagaagaacccttgcccccagtgtcaaatgggatggggatgctagagttatagtaaaggggaaaccctatgtaagctgttaacagagttcacaggggtagggataacccctgttctccagctcccaaatgtgctcactttcccagcttcttcatccgttcatcaatgctggcaaagttcccctcaactgtgg

SEQ ID NO: 421 - DNA, 179 bp, Homo sapien
ccttcctgttgttgtttcaaatgctgcttgatttctcgtaacagatctgcatctatgtaatacctttcttcagatctgactgctccaaaatgattctgcatcctgatttgagacatcaattcatttagtcggcccttgaactgagtaggtgcatttagttcaccctgaatcgtatccag

SEQ ID NO: 422 - DNA, 424 bp, Homo sapien
cgaggtccaaatctgatctgcagatgcagaagattcgacagaagctgcagactaaacaggctgccatggagaggtctggaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcacaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagagg

SEQ ID NO: 423 - DNA, 256 bp, Homo sapien
ctgtggcctagggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcg

SEQ ID NO: 424 - DNA, 330 bp, Homo sapien
ccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcag

SEQ ID NO: 425 - DNA, 333 bp, Homo sapien
  misc_feature (1)...(333): n = A,T,C or G
ctgctccatggnctcaaagtcagcaccacccacacccacaatgatcactgacatgggcaggttcgaggcacgcaccacagcctcacgtgtggcttccacatccgtcacagcaccatcagtcagnagaaacagnatgaagtattgngaggcantcccctgatgtgcagcctgggctgcaaacctggacctgcccgggcggccgctcgaaagggcgaattccagcacactggcggccgttactagnggatncaganctcggtacnaagcttggcagtaatcatggtcatagctgtttcctgtgagcggntgggatgaacgcggccgtacgctcat

SEQ ID NO: 426 - DNA, 411 bp, Homo sapien
  misc_feature (1)...(411): n = A,T,C or G
gggtgttcatcatgaggattgcttctgccatggagctgatggacgtgggcaggttgctgagaaggtggggtggaagtgagtgccgggggtgggtgagtgccctggtcttgttcataggggagcctttccctagcagtggaacgctgtggtcattttctctagcatattcccttgggaagtctagatttgctattaatctggctgagaatctaagttctgtgccttagagacagtttgcactttcccatattgtgcctgggacagccatatgattttttttcccaccaaacaagtatgcaaacagaaaccagttcaaagggggatggtgtaaaagatgaggcagtanaaatgcctttgaatggttttctgtagctaattctctttaaattttgtcctgctttttttctttat

SEQ ID NO: 427 - DNA, 450 bp, Homo sapien
  misc_feature (1)...(450): n = A,T,C or G
acgtgtacaagtttgaactggatacctctgaaagaaagattgaatttgactctgcctctggcacctacactctctacttaatcattggagatgccactttgaagaacccaatcctctggaatgtggctgatgtggncatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctgg

SEQ ID NO: 428 - DNA, 377 bp, Homo sapien
  misc_feature (1)...(377): n = A,T,C or G
cagggctatagtgcgctatgttgatctggtgttcatgctaagttccgcatcaatatggtgacttcttgggagtgggggaccaccaggttgcctaaggaggggtgaacctgcctacgttggaaatagagctggncaaaactcctgtgctcatcagtagtagaattgcacctgtgaatagccnccgccctccagcatgggcaacataacaagaccctgcctcttaaagataaaaattggaaaacactngtaggaaaaaaagggtgnttggtctaaataaatntggattgggnataaatgacncaaaactatcatgaatttgaaagcntttctaatttcttgaaagtctgaaaaaagttaaancncaattttatctnaaa

SEQ ID NO: 429 - DNA, 206 bp, Homo sapien
gttgctcctccaaagaaggttggcttcaaggccgtgtccagggacccacgagcagaggcactggggggcaagggatctccaagggggcaagggatccctaaagggggtagctcacaggtgagggggtttagggcccctctagggagcgcctgaggccatacattcaagagtgtccctggtgaggcccagggaagagccaggactgg

SEQ ID NO: 430 - DNA, 473 bp, Homo sapien
  misc_feature (1)...(473): n = A,T,C or G
ccttatttntcttgtcctttcgtacagggaggaatttgaagtagatagaaaccgacctggattactccggtctgaactcagatcacgtaggactttaatcgttgaacaaacgaacctttaatagcggctgcaccatcgggatgtcctgatccaacatcgaggtcgtaaaccctattgttgatatggactctagaataggattgcgctgttatccctagggtaacttgttccgttggtcaagttattggatcaattgagtatagtagttcgctttgactggtgaagtcttagcatgtactgctcggaggttgggttctgctccgaggtcnccccanccgaaatttttaatgcaggtttggtagntnaggacctgtgggtttgttaggtactgggtgcattaataaattaaagctccatagggtcttctcgtcttgctgtgttatgcccncctcttcacgggcaggtcaatttca

SEQ ID NO: 431 - DNA, 215 bp, Homo sapien
  misc_feature (1)...(215): n = A,T,C or G
cctgtatnaagctanaaaaagactaccagcccgggatcaccttcatcgtggtgcagaagaggcaccacacccggctcttctgcactgacaagaacgagcgggttgggaaaagtggaaacattccagcaggcacgactgtggacacgaaaatcacccaccccaccgagttcgacttctacctgtgtagtcacgctggcatccaggggacaagcagg

SEQ ID NO: 432 - DNA, 391 bp, Homo sapien
  misc_feature (1)...(391): n = A,T,C or G
ccagcactgccacaaactttttcagggccaccaggcgctgcccttccaggaccgggaacctgcccacttctatccgcaggatgtagtgcagtgcagattccaggtcagccatgtagatcctggagcgatctgccaatttccaaacagtgggagctatcttgttagcagtggttggtgcaactgtggtctgggcagcctccctggtgagcccagagagtctctgcaggtaagcggtatagaaggacctggattccatgagcacggggactcgggagacggagccattccggaacagcaggtagcaagaggggaagtcggtgacaccaaactttctcaccacattggcctctgtgttcagcaccctgcgcaccgccacncctttgtgctggga

SEQ ID NO: 433 - DNA, 420 bp, Homo sapien
  misc_feature (1)...(420): n = A,T,C or G
ctgtagcttctgtgggacttccactgctcaggcgtcaggctcagatagctgctggctgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacgtaggacggttagtttggnccctccgccgaatgccgcanttctactgtcccacacctgacagtaatagtcancctcatcttcggcttgggctctgctgatggtcagggtggcccgtgntccccgagttggagccagggaatcnctcagggatcccanagggccn

SEQ ID NO: 434 - DNA, 239 bp, Homo sapien
  misc_feature (1)...(239): n = A,T,C or G
ccaaccangagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggnccccctggaccccagggtcttcctggtctggctggtncag

SEQ ID NO: 435 - DNA, 415 bp, Homo sapien
  misc_feature (1)...(415): n = A,T,C or G
ctgtccaatggcaacaggaccctcactctattcaatgtcacaagaaatgacgcaagagcctatgtatgtggaatccanaactcagtgagtgcaaaccgcagtgacccagtcaccctggatgtcctctatgggccggacacccccatcatttcccccccagactcgtcttacctttcgggagcaaacctcaacctctcctgccactcggcctctaacccatccccncantattcttggcgtatcaatgggataccgcagcaacacacacaagttctntttatcgccaaaatcacgccaaataataacgggacctatgcctgtttagggntntaacttggntactggccgcaanaattccatagtcaagagcatcacagnctctgcatntggaacttctcctggctntcagacctgn

SEQ ID NO: 436 - DNA, 152 bp, Homo sapien
ccaggattgacaggccatccattcacagccaggagatgctgggccagtccctccaagaggtctccgtcatggcagtgatgaaaacctaacagggtggccccctgtgccagctcaggtgactggagcccgagggcctgacaggttcccagcag

SEQ ID NO: 437 - DNA, 174 bp, Homo sapien
ccaggtactggcacatcatgctctggatgggggtggtggtgtcctgtaagcagagaaacaggaaattgtcgtagtcagtatcgagcagctgtggcctcgttcgccaccgtatagttgatcttgaacttctttggattctcagtcttctctccaaggaccttcttctcaacacag

SEQ ID NO: 438 - DNA, 485 bp, Homo sapien
  misc_feature (1)...(485): n = A,T,C or G
ccacggccctctcggccctctcgctgggagcggagcagcgaacagaatccatcattcaccgggctctctactatgacttgatcagcagcccagacatccatggtacctataaggagctccttgacacggtcaccgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccnggtccacaaaggaaattcccgatgagatcagcattctccttctcggngtggcgcacttcaaggggcagngggtaacaaagtttgactncagaaangacttccctcgaggatttctacttggatgaagagaggaccgtgagggtccccatgatgtcggaccc

SEQ ID NO: 439 - DNA, 317 bp, Homo sapien
  misc_feature (1)...(317): n = A,T,C or G
gggccgtcttcccctccatcgtggggcgccccaggcaccagggcagtgatggtgggcatgggtcagaaggattcctatgtgggcgacgaggcccagagcaagagaggcatcctcaccctgaagtaccccatcgagcacggcatcgncaccaactgggacgacatggagaaaatctggcaccacaccttctacaatgagctgcgtgtggctcccgaggagcaccccgtgctgctgaccgaggcccccctgaaccccaaggccaaccgcnagaagatgacccagatcatgtttgagaccttcagcaccccagccatgta

SEQ ID NO: 440 - DNA, 338 bp, Homo sapien
  misc_feature (1)...(338): n = A,T,C or G
ccanaaagacttcccagggaagatgcttggctctctgctccaaggtgggccatggtatagggccctcgaagggcttgtggctggggtgatcccagggggcattgctcaaagtgcacaggaggtggcagcagggtcaggcgagttcctgttccagggacatcaggagggagggtagaagcctagggagtgtgcgaggctgctgggatgagggagctcaggggctaccagctaaccagcctcagctcaatggtttctccatccttgggtctgtagtcagcaataccttgcaacagtggggtgttggggtctcggagaagctgccagaactccctttctcc

SEQ ID NO: 441 - DNA, 505 bp, Homo sapien
  misc_feature (1)...(505): n = A,T,C or G
ccacacagantcaccaagccacagacttgtcttccacaagcacgttcttatcttagccacgaagtgaccaagccacacgtactaaaggttgaactcaaagatatgtacagggtattaaacaaataccaaggggaacagttaacttcaatacaaggtcgaaatcagcaacaagttctacaatccagngctgatatcagatacaagcttcaaggacaatttcttttcgaaggcttattccagtttcgngaggctagcatgaggtgtgtgcatttgccaggggcaaatttctattctcaattaacccatgcagcaaatgctacncatggtgcngagtccgtttagaagcatttgcggtggacgatggaggggcccgactcgtcttactcctgcttgctaatccacnngngctggaaggnggacagtgaggccacggatggagccaccnatccacaccgagtncttgcgctctgggggtgcgatnatnttgatcttcatggtgctgggc

SEQ ID NO: 442 - DNA, 386 bp, Homo sapien
  misc_feature (1)...(386): n = A,T,C or G
cgccaggtgatacctccgccggtgacccaggggctctgcgacacaaggagtctgcatgtctaagtgctagacatgctcagctttgtggatacgcggactttgttgctgcttgcagtaaccttatgcctagcaacatgccaatctttacaagaggaaaccgtaagaaagggcccagccggagatagaggaccacgtggagaaaggggtccaccaggccccccaggcagagatggtgaagatggtcccacaggccctcctggtccacctggtcctcctggcccccctggtctcgatgggaactttgctgctcagtatgatggaaaaggagggnggacttggccctggaccaatgggcttaatgggacctanaggcccacctggtgcag

SEQ ID NO: 443 - DNA, 404 bp, Homo sapien
  misc_feature (1)...(404): n = A,T,C or G
cctccctctcagagcttgccccagggactctctggccctcagggttcaatgtattctgaccaaggccaagctttcctggggctcagggaaaatcacactttgctacccgaagctgtatcccctcagatgccaggaaggccgtgatcatctgactccaccctcctgagacacattctctccctgactgtcctgttctaagtcagcggagcaccttaggatggaggggtggaggcgaggccangatgcagcctctgtgaacaggtgcctggaggctgggaaatgaccctgagagggcaggacacagcnaccgngggcttaaggtgagggnggagagcaagnttggcccactttacaattctagntcagagccancccctaacatggngggcatttattcatttcgg

SEQ ID NO: 444 - DNA, 318 bp, Homo sapien
  misc_feature (1)...(318): n = A,T,C or G
catgggctatagtgcgctatgttgatctggtgttcatgctaagttccgcatcaatatngcgacttcttnggagtgggggaccaccangttgcctaaggaggggtgaacctgcctacgttggaaatagagctggtcaaaactcctgtgctcatcagtagtagaattgcacctgtgaatagccaccgccctccagcntgggcaacatagcaagaccctgcctcttaagataaaaattggaaaacactggtangaaaaaaaggctgtttggtctaaanaagtctggatngggtataaatgacacnaanctatcatgactnt

SEQ ID NO: 445 - DNA, 418 bp, Homo sapien
  misc_feature (1)...(418): n = A,T,C or G
ccagtccaacctgctcctcattattgtataaatgagcagaatcaatatggcggaagccagcttcaattgccaatttggtggcctctaaagctttacttttaggaacctctgcaggcgcataggtgccaaatcccaggacaggcatgaagtgaccatcattcagcttcacacactgatatttcgaatccatttctgtcactagcctggctggcaaatgtttctttcttcctccctcacaggctataagagcaatgagctggcaacgcccctgagcacactgtctgctgnttaaccaatggcatgtgagaggagggacagaggcagtcttacacaagctgtgataaaaattgcatncagttcaaccagtttcttacnttattctaatgngnaggaagtgtgngaagagcacaaagtcaga

SEQ ID NO: 446 - DNA, 361 bp, Homo sapien
  misc_feature (1)...(361): n = A,T,C or G
ctgtccaatnacaacaggaccctcactctactcagtgtcacaaggaatgatgtaggaccctatgagtgtggaatccanaacgaattaantgttgaccacagcgacccagtcatcctgaatgtcctctatggcccagacgaccccaccntttccccctcatacacctattaccgtccaggggtgaacctcagcntctcctgncatgcagcctctaacccacctgcacagtatccttggctgattgatgggaacntccagnaacacnacacaagagctctttatctccancntnactganaagaacagcgcgactctatnccttccagggggggggggtggggnntgnggaccttnccgggcc

SEQ ID NO: 447 - DNA, 321 bp, Homo sapien
  misc_feature (1)...(321): n = A,T,C or G
ccagganantggttccccaaaggggacctcacccgccccgagctctggagccgctgacgctcgcatccaggacatttgagatgggaatccaaataggctacttgnaaaagacgtgctgcangcagccctggagagactcatggagttcattgtacattactccatctaccgaggcagcgcatggcatgactnaacggcttgnaacaaacacanaaattaccaccacaaacattcaggaaccaaatataatctgctatggtcacaccacagacaatgcaggaagaggctttttattgctngngtgngttttcaaatcatgtt

SEQ ID NO: 448 - DNA, 325 bp, Homo sapien
  misc_feature (1)...(325): n = A,T,C or G
ccagcttcaactttttagtatagaagatacaggatcacaaaaaggagactacgctttgcaaacatagcatcaaaattcaacttttctctttgcagtttatccatggngtcagcataccttgcaagggaagctacttacatcaaataacttttctatatacatttcctcattgaccttttctcaaagaatatcttggttttgccgaacaaacataatataggngtctgccagatccattcctggtttctgtngtgaaggaaaagcagggggaacaaaataatatcagggtctcaatngtganattattatttaatcataccctgan

SEQ ID NO: 449 - DNA, 123 bp, Homo sapien
  misc_feature (1)...(123): n = A,T,C or G
cattaatnttggaagcgatggtgtggattacatcagtgttagggcatggtgtggatattattacattannattggaagcgatggtgtggattacatcagtgatagggcacggtgtggatatta

SEQ ID NO: 450 - DNA, 328 bp, Homo sapien
  misc_feature (1)...(328): n = A,T,C or G
ctggcaattttgagctgccggttatacaccaaaatgttctgttcagtacctagctctgctcttttatattgctttaaatttttaaagaaattatattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatngggatgtttttgtaangttaattttctaagactttttcacatccaaagtgatgctttgctttgggttttaactgtttcaacntnggn

SEQ ID NO: 451 - DNA, 209 bp, Homo sapien
ctgccttgtttcaacagacatgcaaagatcctaggagacagtccccatagaccttcagacattaaaaagggagccgtacagtttgtttgaagcacttcgtcttacccatttatgcaggggccccaggaaacttacacacagccagaatgaggttcccaaaggacttacattaattatggctcttgcttcctttcacaaatgagctgagg

SEQ ID NO: 452 - DNA, 457 bp, Homo sapien
  misc_feature (1)...(457): n = A,T,C or G
ctgtctantcccttcaagagctgtttatagaagcttgagaatggggtaaaaatttctgctagcaaaatcaagttctttttgaaattttatcagtaatccagaatttagtagtccatgccttctcactcagcatttagaaataaaaatgtggtttcttaaacgtatatcctttcatgtatatttccacatttttgtgcttggatataagatgtatttcttgtagtgaagttgttttgtaatctactttgtatacattctaattatattatttttctatgtattttaaatgnatatggctgtttaatctttgaagcattttgggcttaagattgccagcaccacacatcagatgcagtcattgttgctatcagtgtggaatctgatagagtctngactccggccacttggagttgtgnactccaaagctaaggacagtgatgaggaagatggcatgtgg

SEQ ID NO: 453 - DNA, 277 bp, Homo sapien
ccaattgatttgatggtaagggagggatcgttgacctcgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactacgagggcgtgatcatgaaaggtgataagctcttctatgataggggaagtagcgtcttgta

SEQ ID NO: 454 - DNA, 198 bp, Homo sapien
gttaaaagatagtagggggatgatgctaataatcaggctgtgggtggttgtgttgattcaaattatgtgttttttggagagtcatgtcagtggtagtaatataattgttgggacgattagttttagcattggagtaggtttaggttatgtacgtagtctaggccatatgtgttggagattgagactagtagggctagg

SEQ ID NO: 455 - DNA, 608 bp, Homo sapien
  misc_feature (1)...(608): n = A,T,C or G
ctgagcaagctaaggaccaggggcaactagaccctaataatgngtacttttgaaaatgatacaaactaccttggttgtaagaagtgcaggttgaacactttaggagaacagtcttcaaactggcaattcaaaatttcccattatatgtgaataaaattggaaggatgttaaatgtccatggaaagttactcttgtaagttaggatgccttatactgaggctttanaatgaaagtacacttcacaaatggaatagtgaacataaattaccagaagtcaagataatagtcatactagtaaggtaagcaaggtaaattcccttatacacaaaaattattttgatgacctttttcaataatgaatctgaaatgaagtgttttaaaaagctccctaaacacaaaacgaacataaaactgcttaataactttagagctcatgtaatattcttgctgaaaacagttactgaaattaccagcgaaatgatggaatatctttaaagcaggncactcngtataatctggaataatttcatttgctaacttttaagaagtattctctggactataaatcntgggcaaatagacttccactttattattaccccaaatta

SEQ ID NO: 456 - DNA, 467 bp, Homo sapien
  misc_feature (1)...(467): n = A,T,C or G
cctggacctgtgtaaaccttcaaacactcttttttacattaggtcgtgaagttaaattttttactgtttctgtgctacagactcttcaaagggaaatagttaagtcaatttcaaagaaaatgaccagcacatttttaaaacattagaaatgatttgactttgactatctactgccaaaaaaaggttaaggaatttgtaatgagaagctaaaaactttaaggaattttaaggaactcaaaacaaaaactcattaaatgtaattaaagtgaattctacaaataaagcctcttaatacatttctataatagtcacttaagacttaaattcaaacactagcaaaccacaaaatcagactgtntgactgacatccaaaagataaatataaatcaaaatccgaccccagcattagccaaggggtaggtgttcctcttgaggaaggcaggaattcctcttctgccacctgttgg

SEQ ID NO: 457 - DNA, 183 bp, Homo sapien
  misc_feature (1)...(183): n = A,T,C or G
ccaaattttntactttaaacactgaaaacagaggaagttaataaaaattttaacctataaagtcccctggttgttagtcattaacagcagattgtcagataagactggtaaaatgatggctgctaagcatttgatgatccaggcgcaggatgatcaaactgcagcagatcatgcacgtgacag

SEQ ID NO: 458 - DNA, 445 bp, Homo sapien
  misc_feature (1)...(445): n = A,T,C or G
gaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggtttttggaagagttagaagaatttggaaggccttaaatatagtagcttagtttgaaaaatgngaaggactttcgtaacggaagtaattcaagatcaagagtaattaccancttaatgtttttggcnttggactntgagttaagattattttttaaatcctgaggactancattaatgggacag

SEQ ID NO: 459 - DNA, 426 bp, Homo sapien
  misc_feature (1)...(426): n = A,T,C or G
cctatgatancttctctagctatcatactccaatcagcaaaaaatgagaaaatgttgagaaatagaagataattcctcatttaaggccaccttctagaatttgtgcttaagattctgctttcttctcatgggccagcacttcggcaactggcaaaaattaggtgtacagggatctaggtaatactgtttatttgagcaataatatattgtgctaacgttcaggcatcctattactgagaaataagggaaaatgagtgtaaagtacaactaagagtctcggcgacagggaaaaataccatcagttaaatatccatagtcctagagcatttatgtaaaactgcaatntgaatcctgcaatacatnttggctttttccctcagtgataccatgtgagggaagnngctctgtcaaggcgggccggataga

SEQ ID NO: 460 - DNA, 348 bp, Homo sapien
  misc_feature (1)...(348): n = A,T,C or G
ccaaattttaaaatgttatttttcatatcatttataaccttgtcacaatccacttaaagaagtttggttatatttcactgaaaattttcttccagagtaggttttttttcgtgggttggggggtaactttactacaattagtaagtntggtgcagaatttcatgcaaatgaggagtgcagcagngtgataatttaaacatatntaaacaaaaacaaaaaaaatgaatgcacaaacttgctgctgcttagatcactgcagcttctaggacccggtttcttttactgatntaaaancaaaacaaaaaaantaannacnttgtgcctgaaatgaancttgtttttttntna

SEQ ID NO: 461 - DNA, 378 bp, Homo sapien
  misc_feature (1)...(378): n = A,T,C or G
ccactaagacagaacggaatctagtagaagtgcaccaatgcttcagtccctcctactcagcatggtgagcagtggtcaatctgtgccctgtggaatgatgggcagataattctggcatgtgtaaataataataaataattcacttggtgcaggcagtatgtctatgaattaaaacctagtgtgtacacagtgcctacatgtgttacagccccacagtaggaatctacaccaaaatatttattagaaggaatttggtccgtactacatcacgctttccggagggtaaaaaataaagtccatctatagacatttcaccacagacccagagactgagtctggctaaaacctgcaaaatgtctataacaaaagnggatggct

SEQ ID NO: 462 - DNA, 197 bp, Homo sapien
  misc_feature (1)...(197): n = A,T,C or G
gcgaggtccacactattaaaagctgttgggtaattgaaggtgatataaaatgactgtcntcatttggagtgngcagcacanttacttcatgttgctcangtttanaacaatntcccctgnaagttctcacacagatnggnagaaatcatacctanttntggtnaatcactatggcagccgtngaagaatntaagaga

SEQ ID NO: 463 - DNA, 279 bp, Homo sapien
  misc_feature (1)...(279): n = A,T,C or G
cataagtgatgangaggnaaaatcantnaataagcctacaacntagaatacattaaaacttgcacatatacatgttcacagcatgtatacaatgataatccctacggtttaaccaagttatggttcccttctacagcagacacaaaaccaaggtgaactaggtnggcagatgtanagggaataccaaaaaaagggtaatnngntcactgattctgaagnatntgactgancatactgagcttctgnactttgggaatgcatnnaggnaacaatatcttg

SEQ ID NO: 464 - DNA, 552 bp, Homo sapien
  misc_feature (1)...(552): n = A,T,C or G
gatgggttgataggtgcagcaaaccaccctggcgcatgtttaccaatgtaacaaacctgcacatcctgcacaggtactccaaaactaaaagtaaaaaaatctaaaagaaaaaagaaaaagaattaaacccaaaatcacttccccatctggacttgatttagatgaaaagcttctggactttgagctgatgctatagtgggttgaaaattttggggtcctcagaaggggatgaggatatattgcatgagagagcaacatgaatcatngagagccagagtatagagagnggtgggtagactgtaggagagccctcaatgatcccggctgtcttgtattcgcgttgcacttacttgtataatatggcagatgggatgtgatgtcactttcaagattangttataaatagactatggcttcaatcagagggttttcttctctgtctanctctcttttgggtagnttcattctgagagaaagccanacctcngccgcnacccacgctaaggggcganttccagcncactggcggccngttactagtggatccgngct

SEQ ID NO: 465 - DNA, 444 bp, Homo sapien
  misc_feature (1)...(444): n = A,T,C or G
ccactcttggtagaaaccttgaaactttcaccttgctgggctttagcaaagtttccttttacagttctgtttatgagcttcagctactgataaagcacttcctgaacttctctattatcatagngaccctctgaataacctgagtgactggctcggcaattcgctttataaccattcttattcccaaagttggagcacataaacatttagatgtcttttcctgtaaaatattctagacatttacccaaactctagttcaacatatactcaacttgcactgtatatctccctgcttttttgagacagagaagaaattcaggaggtgncccatctccagagtttctctgttggaaagcagcnatcaagaancctttaaaaaattggtgtnaagctntgccncctgcagaaatgcntngccccacattattcttctggggnaaagna

SEQ ID NO: 466 - DNA, 381 bp, Homo sapien
  misc_feature (1)...(381): n = A,T,C or G
cctactatgggtgttaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggnttcgggggtcttagctttggctctccttgcaaagttatttctagttaattcattatgcannaggtataggggntagtccttgctatattatgcttggttataatttttcatctttc

SEQ ID NO: 467 - DNA, 95 bp, Homo sapien
  misc_feature (1)...(95): n = A,T,C or G
cctatanattntggnttgtatactgggtcctgaaaaccctcttggngctctgtttttaaggagctgaanccaangancgccaataataatacttt

SEQ ID NO: 468 - DNA, 224 bp, Homo sapien
cagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccagg

SEQ ID NO: 469 - DNA, 416 bp, Homo sapien
ctgagttctagttcaaaagctttatccttaacttcgtcatgtactatgtaaattctagaatagaaaagggaaaggtaagattttggtaacctccaaacattgaagtagttcacagacccaaagtcagtacaaattagaatgtccatccataataaaagtatctataaaattacacagacacattctacatagtatttaacattagagaagacaaattacacagggactgaaataaaatgaaacatctactctcccgacaaatgttgaatatacctaatcaacccaagttcagtttatttttgcacattgctttagagatataacttggctgggcacagtggctcacacctgtaatcccaacactttgggagaccaaggcggatggatcacttgaggtcagttcgagactagcctgg

SEQ ID NO: 470 - DNA, 376 bp, Homo sapien
caccttttaactgtatcacaaagtctgttgctgtggttacagcctttgtttccagtgatgttttgtccatgctttcccccaacccttaacaatggttactcaaaagaatgaaataatgagtcattcattcgggaatatgttaaaatatccctctttatcattacatttcactgcttagaaactaggctgtaattcaaggcaacagttaagtctgagaactgttaaaaaaatctttgattttttttcatttttaagaaaaacctgcctatttaattgttcagacttgtaagaggttcttcaattacatcctttttggttaatgtattatttctggaacaagtagataaaattctacgcagtaagcataataaaaatc

SEQ ID NO: 471 - DNA, 357 bp, Homo sapien
ggcttcgtataatggttcttttgtcacccctgatcgacgatttcgctacccgtacaactctgacaagggaacgaaatgcttctgtgtattcacctagtggtcctgtgaacagaagaacaacaactccaccggatagtggagtactgtttgaagggttaggcatttcaacaagacctagagatgttgaaattcctcagtttatgagacagattgcagtaaggaggccaactacggcagatgaaagatctttgcggaaaattcaagaacaagatattattaattttagacgaactctttaccgtgctggtgctcgagttagaaatattgaagatggtggccgctacagggatatttcag

SEQ ID NO: 472 - DNA, 557 bp, Homo sapien
  misc_feature (1)...(557): n = A,T,C or G
cngagatgacatttacaatctcttgaaangcagcagatggcactctggtgcttcctatgaagcaacatgcttgaaatcaagggccaacaattgttgtaggaaagcaaaatatacctctaacacctacgtttaccaaaaaagctgacatctcaaactctgagttgttgagactcaaatttctcatccccaaagaagcctattacggtagtgtgntggatgctttttgtatctctgataggcaggcactataatggggggaaatacttctgaataaaaacattggctgtcttgcaactgtgcatataatgtctattcaagggggcagtgtgcctagcatgatcctgaaatgttgagataaaaggaagttggcattaaagcactatttgtcttatatgaaaagagtgactctatcttccagtaaacaaganttcctgcaatgaaaaagaaattttttccttcattatctataaactatacaaaataaccttcctttttaacctaagactcaaacattnatatttgattttattctatttgataccaattggtatgtccag

SEQ ID NO: 473 - DNA, 264 bp, Homo sapien
cctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcag

SEQ ID NO: 474 - DNA, 165 bp, Homo sapien
aattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccag

SEQ ID NO: 475 - DNA, 417 bp, Homo sapien
  misc_feature (1)...(417): n = A,T,C or G
aagttctcttcttgttttaaacacattcctgataacttctaaagatgaccaaaataaaacagaatatctacagagatcattttctgaattttttgtacatccaaggataacaacataaaaaaaataaaactggacagcattccacatccaagtgcacagaaccatttttgcaagattaaataatgtaaacattgggaacagccaaatcagcgaagaatgccaacacctcaaaacacctggtgttgccgcttcattaagtggttcaaaatccagatctataattgcgcaatattcaccgtatataaaaagaaatggatattaattttgacaaatagctgcaactgagacttctttttatttctttatatgngnatatagtgaatttttattatttttaaaattttatttattttttta

SEQ ID NO: 476 - DNA, 321 bp, Homo sapien
  misc_feature (1)...(321): n = A,T,C or G
catttaataacaaaaacaacctgtacggaaaacccnaaggcaaccacatagcatatgtaaaatgtgcaaatacactttaaaatgcangttattctatagcanttgcaagatagaatttcactgtaattagggaatctagctcatcctaacttaatagncttttgcatgtntagacaatgcaattctacaaggnacnactcagcgttgatgctaaagtatgaaacacatcctcagattattcatccgaaaatattaaaatagcntcatgttttattattctttaatgagtcntgagctcatttctaaagcttcataaagcat

SEQ ID NO: 477 - DNA, 546 bp, Homo sapien
  misc_feature (1)...(546): n = A,T,C or G
gctgtggttatattgtaaatgaagcatctaacatgtgcacaacttgcaacaaaaactccttggactttaaatctgtctttctcagtttccatgtgctgattgatctgactgatcacacaggcacccttcattcctgtagtctcacaggaagtgttgctgaggagactttgggctgcacggtacatgagtttcttgcaatgacaaatgaacagaaaacagcattaaagtggcaattcctcttggaaagaagcaaaatttatttaaaattcgttctatcacacagagcaaggagtggattgaaaattagtgtactctcgtgcaagcttgcagatcctactgaggcaagcagaaacttgtctggacaaagacatgtttaaaacggtctatcattttgaactctggaaaagtataagagttttaactccctttaaaatggaatattaatttgaaaattatggggaaaattgcattttgtttacatgtggtgaacatgtttctagaaattggtatggcgggaagggggctgggtgagtctgaaggacctcn

SEQ ID NO: 478 - DNA, 100 bp, Homo sapien
aagaaaagtggtaaaatcaagtcttcttacaagagggagtgtataaaccttggttgtgatgttgactttgattttgctggacctgcaatccatggttcag

SEQ ID NO: 479 - DNA, 508 bp, Homo sapien
  misc_feature (1)...(508): n = A,T,C or G
gnnttccaaattcttctaactcttccaaaagccttctgccttagttttttttaaattacaccagtccttttagtagctttttgatgtgatttttaaccaacttccccttctagcttcaagtattcttctaaattggtcctggtctacgtaaacaccctcatcttctcaagctttaccttctaacttctgcaccaccagaaattaaattgatgggcttttaaaataaattggttaccaataatttcctcattttttcagtgctattttatccaatttttggctttatatttttctatcttctatacttctccaatacttgtcttagcttgtttttcattttctatctgaaactcttgacaatatcttctaatttccctatcttctctattcttttcttcgccttcccgtacttctgcttccagntttccacttcaaacttctatcttctccaaattgttcatcctaccactcccaataatctttccattttcgtgtagcacctggncag

SEQ ID NO: 480 - DNA, 81 bp, Homo sapien
ggtgcccttttcctaacactcacaacaaaactaactaatactaacatctcagacgctcaggaaatagataaggaaaatgac

SEQ ID NO: 481 - DNA, 306 bp, Homo sapien
  misc_feature (1)...(306): n = A,T,C or G
tcgccttcggccgccgggcaggttaggggnacaagacgctacttcccctatcatagaagagcttatcacctttcatgatcacgccctcatagtcattttccttatctgcttcctagtcctgtatgcccttttcctaacactcacaacaaaactaactaatactaacatctcagacgctcagggaatagaaaccgtctgaactatcctgcccgccatcatcctagtcctcatcgccctcccatccctacgcatcctttacataacagacgaggtcaacgatccctcccttaccatcaaatcaattgg

SEQ ID NO: 482 - DNA, 582 bp, Homo sapien
  misc_feature (1)...(582): n = A,T,C or G
ggggggaacagtcattatacattatttagactcattccttcttccagtgcccttatgattatttcctacctttaccattgatcttaaactgngcaggctaaaaagaggaaccagaactcccttaagcacttttaagactatttaaaaaataaagntttgttggcattgaagagtaagctgcttaagggactgaatgaaaagatagtaccctttgtggctgtatgaagagagaaactgaatttctatccaagagaccttaatntagcctattagggaattatcttccccaaaagtacaagtaattttgcactgcaggagaaggataagtagatttgatttacatcacattttatacacacctttcaaganggagaaatctgcttcataaatagnaggaatctatgcttaaactnaacatttaatggtgacntcttacaacagccttgaaaannattggaantcngacntganggnggaaactggaanaaagaatatctttctcttctgcatcctttnatcctcaaacttagcatggattcacacgctgaggaaangttnggtnacnaccngaacatttagata

SEQ ID NO: 483 - DNA, 275 bp, Homo sapien
  misc_feature (1)...(275): n = A,T,C or G
gcctcactaaaataacagatttcagtatagccaagttcatcagaaagacccaaatggaatgatttacaaaatagaacactttaaaccaggtcagtcctatctttttgtagctgaaggctatcagtcataacacaatttcgcgtacacctctgctcattatggaattacacttaaaacgaatctcaagagggtgaccattgttgtttcagataccatccctaaggagagtggttaacaggaagattgccagngttactgatggaaagaagcgcttg

SEQ ID NO: 484 - DNA, 434 bp, Homo sapien
catatttccacaggccaatttctttctgtttttctgctaagctatttcagcattttagcttttcctctttgctttgtttactcatgattgccagatggctacgttacctctaagcatcagatcctcacaaattaatggttaaatgtaagggagggattttactctcttgcattaaaaaaaagctttattgagatataatttactgtaacattgactcatttaaagtatgctagtcaatagaccaaatcttgaataaactcccattcacaattgctacaaagggaataaaatagctgggaatatagctaacaagggaagtgaagggcctcttcaaggagaactacaaaccactgctcaagaaataagagaggatacaaacaaatggaaaaacattccatgctcatgaataggaagaatcaatatcgtgaaaatgg

SEQ ID NO: 485 - DNA, 291 bp, Homo sapien
  misc_feature (1)...(291): n = A,T,C or G
ncaccactgcagccctacatacagttgaaaaaaaattccattctgttaacatttgttttataagttttcacgcaatacacaaaaaacccctctgcacttcttgtaaagaacaaaaaagatacacaacagttaagcgtaaagatcacaggcaatagcattcaaacatggatgtgggtagagaaaggagtacctggcatgagtacctgcttagtttgactgaatccttgatttttaatttggcttttcatgggccgctcacaacaccaacgctgtgtgaggtatggtagtcag

SEQ ID NO: 486 - DNA, 274 bp, Homo sapien
ctgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgattgttctgtaactagttgctctcattttaatttcactgg

SEQ ID NO: 487 - DNA, 184 bp, Homo sapien
  misc_feature (1)...(184): n = A,T,C or G
tggcaccaagattctcagctcacggtaccagcatctgattgtcggactacctgctgctttccctgatatttatacatgatattcgnaaaatgtaaagaagctattattcatacagacatctagagaaggagngaagnttttaaaaaaataaaaaaatacttatttcaagctttagctgtgttct

SEQ ID NO: 488 - DNA, 393 bp, Homo sapien
ctgcatttttattgcgatctgcagatgaactggaaaatctcattttacaacagaactgggacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccag

SEQ ID NO: 489 - DNA, 607 bp, Homo sapien
  misc_feature (1)...(607): n = A,T,C or G
gtgcttatgtacttaaggggaactactctaactgggtgaagagtangatgaagcatccatgtccctacaaaggatatgaactcatccttttttatggctgcatagtattccatggtgtatatatgccacattttcttaatccagtctatcatcgatggatatttgggttggttccaagtctttgctattgtgaatagtgtcgcaatgaacatacatgtgcatgtgtctttatagcagcatgatttataatcctttgggtatatacccagnaatgggatagctgggtcaaatggtatttctagttctagatccttgtggaattgccacactgtcttccacaatggttgaactagtttacagtcccaccaacagtgtaaaagtggtcctatttctccacatcatctccagcacctgttggttcctgactttttaatgattgncattccaactggtgtgagatggtatatcaccgtgggtttgatttgcatttccctgatggccagtgatgatgaacnttttttcatgtggtttttggctgcataaatggcctgccttttntacttctataaaatttttcanntcttattattattcctgggggnttaag

SEQ ID NO: 490 - DNA, 179 bp, Homo sapien
  misc_feature (1)...(179): n = A,T,C or G
cttctaggaatactagtatatcgctcacacctcatatcctccctactatgcctagaaggaataatactatcactgntcattatagctactcccataaccctnaacacccactccctcttagccaatattgngcctattgccatactagtctttgccgcctgcgaagcancggtaggacc

SEQ ID NO: 491 - DNA, 399 bp, Homo sapien
  misc_feature (1)...(399): n = A,T,C or G
cctctacctgtaatcacattaatttttctaaagacaggggnggtgttttgaagataaatgtcattagtctatgataatagcatcataggacaattagccattttagacttgaccatattttctctttttagcatatagccatcttgatatttaggngggagactactccaatggagcaacagtttcattttacatgattggatttagaaatttacaaattttaaactcataagaattctaaataatttgaaaatggaaacatttgacccacagtctagcagcataaatacatttataaaatacttcattgttgatcttaggtcattgatttaaaacagaatttggtgactatgggcaggtggagggggccngtgaggaaggtataaaagagaaatcttt

SEQ ID NO: 492 - DNA, 482 bp, Homo sapien
  misc_feature (1)...(482): n = A,T,C or G
ctccaccttactaccagacagccttagccaaaccatttncccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggggagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtagg

SEQ ID NO: 493 - DNA, 207 bp, Homo sapien
  misc_feature (1)...(207): n = A,T,C or G
cataaatattatactagcatttaccatctcacttngnggaatgctagtatatcgctcacacctcatatcctccctactatgcctagaaggaataatactatcactgttcattatagctactctcataaccctcaacacccactccctcttagccaatattgtgcctattgccatactagtctttgccgcctgcgaagcagcggtagg

SEQ ID NO: 494 - DNA, 283 bp, Homo sapien
  misc_feature (1)...(283): n = A,T,C or G
ccaattgatttgatggtaagggagggatcgttgacctngtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactatgagggcgtgatcatgaaaggtgataagctcttctatgataggggaagtagcgtcttgtagaccta

SEQ ID NO: 495 - DNA, 590 bp, Homo sapien
  misc_feature (1)...(590): n = A,T,C or G
tatgtatataattttcttagttactagcatagagaaattactgatttaaaaaaacatttcaaattctagcatgttgtaggattctattgccctttctaaaaagtacatcttgcttatccgatttctaacaaaactatttaatttgaagaagggagaatgaatttggataaaaagcaaaaatttaaaggtactcaaatttaggcaaaccattaaagcaatcttagtttacagttaattgggtagaatggtcaacactttcttcaggttagttcatggagtggatatgcattgatagaacaacttagagatgcttttacagttgagaaagctcattatatttgttatctttaagaatcagcttatttatttcatatgtttgttctttaagaagaccaaagagccctgcaaatgaatgttgatttgtttttttgtttgtttaatatttttgtagagataagatctcactttgttatgttgcccaggctggtctcaaactctcaacttgaagtgatctgcccacctcagcctcccaaagtggtgggattacaggcatgagccaccgcacctggacctgcccgggcggncgctcg

SEQ ID NO: 496 - DNA, 307 bp, Homo sapien
  misc_feature (1)...(307): n = A,T,C or G
ggagattagtatagagaggnanacnttttttcgngatatttggtcacatggataagtggcgctggcttgccatgattgtgaggggtaggagccaggtagttagtattaggaggggggnngttagggggtctgaggagaaggttggggaacagctnaataggttgttngntgatttggntaaaaaacantagggggatgatnctaataattantgctgtgggtggttgtgntgattcaaattatgngctttttcggaganncatgtcangtggtagtaaatataattgttgggaccattanttcttan

SEQ ID NO: 497 - DNA, 216 bp, Homo sapien
  misc_feature (1)...(216): n = A,T,C or G
cattttcctcttggtttcttcagttaagtcaaanngncacgttcctctttccccatatattcatatatttttgctcgttagtgtatttcttgagctgttttcatgttgtttatttcctgtctgngaaatggtgtttttttttgttgttgntggtttttttttttttttttaaactnggnaccncnaanttgaaaaaatgnttntttttccctnaca

SEQ ID NO: 498 - DNA, 375 bp, Homo sapien
  misc_feature (1)...(375): n = A,T,C or G
gaatttcctggcaccttttctcgctagagaagattnngtgtgactgggttgcctataagccatatagatacaaacttttatctctaataccaagtcttagagggatatattaatagatctaataaatttattcttagacttattgtttcatgggntagtgagtctttgctactggagacaatacagacttgtcagtttttttaaaaaaaaaaaatttgccaagctancacattaaaaanatntcctaaggctntcattttatgaggatgattataaacntttntgngataaatatcaccataataaactgttaagtacaactgcnggccncccttanagngaattcctncagttanaaatttatttttttgccaa

SEQ ID NO: 499 - DNA, 215 bp, Homo sapien
  misc_feature (1)...(215): n = A,T,C or G
ccacnaaagcagaagcttaaagcatagtagtaaagaggnnaaaaagaaggacgaaaataaatcagatgacaaggatggtaaagaagttgacagtagtcatgaaaaggccagaggtaatagttcactcatggaaaagaaattaagtagaaggttgtgcgaaaatcggagaggaagcttgtcacaaaaaaaaaaaaaaaaaaaaaaaaaaatgtttt

SEQ ID NO: 500 - DNA, 489 bp, Homo sapien
  misc_feature (1)...(489): n = A,T,C or G
ccactacgataagcaggtagctgggttttgtagtgagnttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggnttgtctactttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgctta

SEQ ID NO: 501 - DNA, 286 bp, Homo sapien
aaaaacactcaaacacagccttggagggaggagtcagttttaaaagactcttataaaagtaatatactgctagctctgaagaatcggaggctaaaatcatctcttcaagtccccagggaatcccaaagaactccaggggaaggtgggatgggccagagagctctggaagcttccaggtctgttgcaagcctcacctggtacacagtaggctcttccaggtctgtcaggaacccaggagcctcccctagcacacagtaggctcacaaaaagggagcactgctgctgg

SEQ ID NO: 502 - DNA, 168 bp, Homo sapien
  misc_feature (1)...(168): n = A,T,C or G
cctatgattgtgggggcaatgaatgaagcgaacagagnttcgttcattttggttctcagagtttgttataattttttatttttatgggctttggtgagggaggtaagtggtagtttgtgtttaatatttttagttgggtgatgaggaatagtgtaaggagtatggggg

SEQ ID NO: 503 - DNA, 173 bp, Homo sapien
  misc_feature (1)...(173): n = A,T,C or G
cctttataataaattaggcaaaaggttcagtgcnnggctatantggacaacatgaaactccataaaaatgactggatagggggactgcttgagacttttcttttgggcattactaacagaattcaaagaaattccaaccacgcttatttttccaaattctactgaaatgagag

SEQ ID NO: 504 - DNA, 310 bp, Homo sapien
  misc_feature (1)...(310): n = A,T,C or G
tagtattctatttaaaaattaagttttggggtctgtaaaatatacaggacaatgacttttttaaaatgtaagttaatacctcctcctcacttgtcttaattgaacttaggtgtttattcttaaaggnggaccttgatgaaaatgttgagatgggaagtgttattaggcaaaacttgttatagatttctcatataactcttaattgacccttagaattttaacaaccgcgcctggcccaatagactgttttttagagtanttttaggctctcancaaaattgaggggaaaatacagggtgttcccattaaa

SEQ ID NO: 505 - DNA, 530 bp, Homo sapien
  misc_feature (1)...(530): n = A,T,C or G
cctcagggaacttacaattatggcaaaaggggaaggggaagcaagcaccttcttcacaaggcatcaggagagagagagaaagagagtaggggaaactaccccttttaaaccatcatatcctgtgagaactccctcagtattagaagagcatgagggaaaccgcctccataatccaatcacctcccaccaggaccatccctcaatacatgggggttacaattcaagatgaggttcgggtggggatacagatttaaaccatatcagaatggttaatgatattgttgtattttaccaactataatcttcttagtgttatagtacaataatgtaaaaaattgagtaaatttgttttctatattattctgtttttggaaaacatgtatatagtcagggctgtttgtctcaagaaaatatggtaaactctgctgttttggtcactggtgcctagaatttggggatgtacattggttttgattcacatgcacatttccttctagttcacagtaactatttctaactatttcccnata

SEQ ID NO: 506 - DNA, 352 bp, Homo sapien
  misc_feature (1)...(352): n = A,T,C or G
cttgaacgctttcttaattggtggctgcttttaggcggtactatgggtgntaaattttttactctctctacaaggttttttcctagtgtccaaagagctgttcctctttggactaacagttaaatttacaaggggatttagagggttctgtgggcaaatttaaagttgaactaanattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaanntatttctagttaatt

SEQ ID NO: 507 - DNA, 370 bp, Homo sapien
  misc_feature (1)...(370): n = A,T,C or G
cctaactagatcttatcagaataggggggaagggngtcggttcatccttattgagtgttaatgaccctgtaagatgtaatttcttttatttcattctgttacctagaaaatctatcacagccttgtagtattgattgctcaatctataaagagctcagtttacagcatgactgttagtaacagggntattttaatgagtgactcttcaacacctcagagtttcactaaattccaacccatcagcccagtagtctaacattaagggtcttaggaaatgagaacttatcacctttccttatcatgaaaaggtaacctccaggtaaccaaaaatagaacttcctctgtgttcgttttttatagaaattactgg

SEQ ID NO: 508 - DNA, 129 bp, Homo sapien
  misc_feature (1)...(129): n = A,T,C or G
ctgttaaaagaacaaacttagcaatatataacagttnggtaacaggatttttgactattcactttgggagttatttttaaaaatccacttttttactgagtcttactacataccaggcactgtacttgg

SEQ ID NO: 509 - DNA, 422 bp, Homo sapien
  misc_feature (1)...(422): n = A,T,C or G
ntgggaagtcgtgacatccatgggaacccagcgctgtgatgctggtgtttgngttctccgcgagaagtgaccattgttggagcaccatccagagctagtgaccantncagtggacagttagtgggagaatcaaaaatcctttccagaatgtctgtttctcactacntgcaccgggngattacaggcaccagtgcagngatgattgtacttatttgacacatactccccgtcntcctggntnttgttcctganaanggtgggtaaatattccaggaaaaanaatgcacattgaatggatgtgagagaccacattgcctctcccactgctttggggagcactttcctgtcatttctaacttaccacntgcttggtgtactatatgtatgttgtgcctcatatgttgcaaagaactaangtgagt

SEQ ID NO: 510 - DNA, 238 bp, Homo sapien
ccacctatgaattggtggtttacctactcaatggatagcagcacgaggactgctgtactgcacaaaaagaagaccaaaagattacagtggaccatgggatacagaagccagcatggcagacagaagaaaaatagtttgggaacatgtaactatcctaagtggaagttttgttgtaggaattatagtaatcacaccacattacttggcctttcggtaatgtgaaaaaaaaaaaaaatcc

SEQ ID NO: 511 - DNA, 254 bp, Homo sapien
  misc_feature (1)...(254): n = A,T,C or G
ccnattgatttgatggtaagggagggatcgttgnggctcgtctgttatgtaaaggatgcgtacggatgggagggcgatgaggactaggatgatggcgggcaggatagttcagacggtttctatttcctgagcgtctgagatgttagtattagttagttttgttgtaagngttaggaaaagggcatacaggactaggaagcacgataaggaaaatgactatgagggcgngatcatgaaaggtgataagctcttct

SEQ ID NO: 512 - DNA, 269 bp, Homo sapien
  misc_feature (1)...(269): n = A,T,C or G
cctacctgtaaactacagtactttatatatctatgggnttaataaaaanaaaatccacaaatcttaaaaaggaactttaaatgcagggctatattgaattggnaaactgcaacacaaactggcgcaacataggtaaatgaataccaatctcactctatgtgatgcaagcatgctactttcccactaatttaaattactttcaaccactatgagccagaatgcatgcctgaaccttaaactgcactttaaaaagtaacatcttggcctaa

SEQ ID NO: 513 - DNA, 266 bp, Homo sapien
  misc_feature (1)...(266): n = A,T,C or G
ggaggggggttgttagggggtcggaggagaaggntggggaacagctaaataggttgttgttgatttggttaaaaaatantagggggatgatgctaataattaggctgtgggtggttgtgttgattcaaattatgtgntttttggagagncatgncantggtagtaatataattgttgagacgattagttttagcattggagtaggtttaggttatgnaccgtactctaggccatatgtgttgganattganactagtagggctagg

SEQ ID NO: 514 - DNA, 271 bp, Homo sapien
  misc_feature (1)...(271): n = A,T,C or G
acatgcaanaaatcgagaatcttaaaaaacannacgaanctgccctggaanncttactggnntangatatttatnttgcggctgagatacttgaacaacttcggatcngaantagacaanaangggnanttntatactgcnncagaggttacacagntcattgtattagagangaacanatgggtctggtgttcacacattggggggaanatgggcgtnnacangagaggnnganaaacnanganagcctncctggttngcataanaaaaa

SEQ ID NO: 515 - DNA, 328 bp, Homo sapien
  misc_feature (1)...(328): n = A,T,C or G
ccaatgaggggcaaagtgagcgncnagaagangttttgactgaaataaatcaaacacaaaaatntaagttcacagtgacagtttaaacaaaatccaaacaaactaacaacanaaacaccccttgntttgcctctagtggaaggtggganaacacaanctcgtcctaaaaattgactagtaaaggggaaaacccggtcatttncctactctttccangaaatatctaatgcaagaaagaacttctnctcattatacngaaggaatttngaaaaatgatgtatttttggaacacctaantgaaatactggaacctgggcaagttcaccac

SEQ ID NO: 516 - DNA, 220 bp, Homo sapien
  misc_feature (1)...(220): n = A,T,C or G
ncctnagttgaaggaccccatgtacatacaggccaggggagcagtactaggntaactagaaggatctcatccccatatgtgggctcatttcaagtctatggatgactaccttcattgntgtgtgcgagatggtttcaccccttgaaaatatgggcacttcancataanatagcnaaatctttataatgatcaatncatcctacctccttttacatgcatg

SEQ ID NO: 517 - DNA, 296 bp, Homo sapien
tgcgatttcttccttgttgtttgctttggtctgtgttcaatccagagagcttaaattgtcattattttgggaagaaaacctgtatttttgttagtttacaatattatgaaatttcacttcaggagaaactgctgggcttcctgtggctttgttttcttagtttctttttccgtgccgtgtattttttaattgatttttcttcttttacttgaaaagaaagtgttttattttcaaatctggtccatatttacattctagttcagagccaagccttaaactgtacagaatttccactg

SEQ ID NO: 518 - DNA, 299 bp, Homo sapien
  misc_feature (1)...(299): n = A,T,C or G
gaagatagaaaaatataaagccaaaaattggataanatagcactgaaaaaatgaggaaattattggtaaccaatttattttaaaagcccgtcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaagg

SEQ ID NO: 519 - DNA, 464 bp, Homo sapien
  misc_feature (1)...(464): n = A,T,C or G
gctgcacatcggaggaaaactcggtaaagcagaatgaggttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaggtatttcatacagtttaacagatcgggaaacttctgtgaatgtcattgaaggtgatagtgaccctgaaaaggttgagatttcaaatggattatgtggtcttaacacatcaccctcccaatctgttcagttctccagngtcaaaggc

SEQ ID NO: 520 - DNA, 221 bp, Homo sapien
ctgatatctacttatttaacacaagtctctaatacaatacaattttattaattttattccacatgccccacattagatctctagactcattcatcctacatacctactttgtatcctttgacctacatctccctacttcctcctccagtccccaccccccacccactggtgctaaccactgtttcattccctttttcattctacatatgtgagatcatgct

SEQ ID NO: 521 - DNA, 312 bp, Homo sapien
  misc_feature (1)...(312): n = A,T,C or G
ctgatagctttctcttcgcctagattaatatcttctnncttcccattcacagcccccaccgacatcaaagctttgctgttttatctgtcaaaaatgtcttcacacttttcattcttaaataaaagtgctgagtaaggacattttcacaacaaatttttattttacaaaacttacaatgatttgaatccaaaacaactttcattatttaactgtaaagtaaatatatattttattaggngtgtcttagttcattttgtgctgctttaacagtgtatccttgtgatagttgtggggtgggggaggggggaagga

SEQ ID NO: 522 - DNA, 336 bp, Homo sapien
ccttctttccccactcaattcttcctgccctgttattaattaagatatcttcagcttgtagtcagacccaatcagaatcacagaaaaatcctgcctaaggcaaagaaatataagacaagactatgatatcaatgaatgtgggttaagtaatagatttccagctaaattggtctaaaaaagaatattaagtgtggacagacctatttcaaaggagcttaattgatctcacttgttttagttctgatccagggagatcacccctctaattatttctgaacttggttaataaaagtttataagatttttatgaagcagccactgtatgatatttttaag

SEQ ID NO: 523 - DNA, 172 bp, Homo sapien
  misc_feature (1)...(172): n = A,T,C or G
ngacnggcncntggctatgtntatagatagggctttaaccactatctgngaagcangagngacannattcttgctctcacatnccacngganacgtatttctcttctcttacnagcgaagaaccatctntttctaaagcccccattctattgcccttgcttttctctggctt

SEQ ID NO: 524 - DNA, 471 bp, Homo sapien
ccagacctgcagaaaaacttagcacagctcaatctgctgttttgatggctacagggtttatttggtcaagatactcacttgtaactattccaaaaaattggagtctgtttgctgttaatttctttgtgggggcagcaggagcctctcagctttttcgtatttggagatataaccaagaactaaaagctaaagcacacaaataaaagagttcctgatcacctgaacaatctagatgtggacaaaaccattgggacctagtttattatttggttattgataaagcaaagctaactgtgtgtttagaaggcactgtaactggtagctagttcttgattcaataagaaaaatgcagcaaacttttaataacagtctctctacatgacttaaggaacttatctatggatattagtaacatttttctaccatttgtccgtaataaaccatacttgctcaaaaaaaaaaaaaaccttc

SEQ ID NO: 525 - DNA, 332 bp, Homo sapien
  misc_feature (1)...(332): n = A,T,C or G
ccccnctgtattccagcctgggtgaccccatctcanggaagaaaagttaccagatgtcgngggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaa

SEQ ID NO: 526 - DNA, 440 bp, Homo sapien
  misc_feature (1)...(440): n = A,T,C or G
ccaggttacctcccctaacagatgtggtgttctgangggttggttaagtgcccgaggaaaataggccttaactgttaacatctacagagaagaaagcatggtcacactggcaaggagtaagaagggattgggtaaaagaaaatgggagagaaaagggaaaaaagttttggcaagacaattgttccctgctaagaagctgcagggtgaaagctttcctttcttctatttttgtttttaatgnctgtctctctgatcagnggaaaagtgaaaatttctagtatctagcactaacgtatgacccaactttgagggatcacaagctagaacaagttgaggatttaaaatcctggataattatatacttaaagttcatgagcataaagctcacttgaccatgcagaaatgctgggaagcagggtgcatggcatgggaatacatct

SEQ ID NO: 527 - DNA, 124 bp, Homo sapien
  misc_feature (1)...(124): n = A,T,C or G
tttccatatgtctgttgggtgcataaatgncttcttctgagaagtgtctgttcctatcctttgccccctttttgaggacttaaatgttagacctaagaccataaaaaccctagaagaaaaccta

SEQ ID NO: 528 - DNA, 162 bp, Homo sapien
  misc_feature (1)...(162): n = A,T,C or G
ctgcgggagaaatatggggacaagatgttgcgcangcagaaaggtgacccacaagtctatgaagaacttttcagttactcctgccccaagttcctgtcgcctgtagtgcccaactatgataatgtgcaccccaactaccacaaagagcccttcctgcagcag

SEQ ID NO: 529 - DNA, 409 bp, Homo sapien
  misc_feature (1)...(409): n = A,T,C or G
cctttaaaatatagcttataaaatgtatactatnngccaggagagctcacatttttctgcagttttccagtggacctgcctatggaatactgtaaagaaaaatctgcaaaaatattcctagcaattgaatcagtgcttttaaataaaagaagtggagaggggcttggttaaattattctgacaagttttcttgctagtggttgccaaaattaaggatatttgaagtgtcctatcacccaaatttggctttaagaaaaagctatattctgngtctatagggtgaagcccacactatctgtgctgcattctcaatgatacaatacctatctggaaactttcctgttttgccaatgggtgcacaaatctaaaacattttatcacaaaaggtacttgaatttaaatttctttt

SEQ ID NO: 530 - DNA, 325 bp, Homo sapien
  misc_feature (1)...(325): n = A,T,C or G
ccgccagtgtgatggatatctgcagaattcgccctttcnagatttgngcccgggcaggtccatggctaggattatagatagttgggtggttggggnaaatgagtgaggcaggagtccgaggaggttagttgtggcaataaaaatgattaaggatactagtataagagatcaggttcgtcctttagtgttgtgtatggctatcatttgttttgaggttagtttgattagtcattgttgggtggtaattagtcggntgttgatganatatttggaggtggggatcaatagagggggaaatagaatgatcagtactgcggcgggtagg

SEQ ID NO: 531 - DNA, 173 bp, Homo sapien
  misc_feature (1)...(173): n = A,T,C or G
ccaattgatttgatggtaagggagggatcgttgaccncgtctgttatgtaaaggatgcgtagggatgggagggcgatgaggactaggatgatggcgggcaggatagttcagacggtttctatttcctgagcgtctgagatgttagtattagttagttttgttgtgagtgttag

SEQ ID NO: 532 - DNA, 395 bp, Homo sapien
  misc_feature (1)...(395): n = A,T,C or G
caggtcctactatgggtgttaaattttttactctctctacngggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcanaaggtataggggntagtccttgctatattatgcttggntataatttttcatctttcccttgcgg

SEQ ID NO: 533 - DNA, 290 bp, Homo sapien
  misc_feature (1)...(290): n = A,T,C or G
ctgaaccattatgggataaactggtgcaaattctttgccttctctacttctcactgattgaacataagcttccagggctcccctgaaaaccaaaatgaaaacaatgtcaaaatattagataaatcacataaaacagttaaggggataccaatatataaaaattattaggtaagctcatttctggaactgttaatgctcggtttcacaatccaagnngaccaacagccttcactcagntactggnagtgntactatggttactacngntactacctttagtgtnaaaaact

SEQ ID NO: 534 - DNA, 334 bp, Homo sapien
  misc_feature (1)...(334): n = A,T,C or G
ccgccagtgtgatggatatctgcagaattcgcccttagcgagnnagccgggcaggtccatggctaggtttatagatagttgggtggttggtggggnatgagtgaggcaggagtccgaggaggttantttgtggcaataaaaatgattaaggatactagtataagagatcaggttcgtcctttagtgttgcgtatggctatcatttgttttgagggtagnttgattagncattgttgggnggtaattantcggctgttgatganatatttggaggtggggatcaatanagggggaaatanaatgatcagtnctgcggcnggtnngacctcngccc

SEQ ID NO: 535 - DNA, 557 bp, Homo sapien
  misc_feature (1)...(557): n = A,T,C or G
nccataagcttcagtgcgcaaaaggtcaaggccagtgttaatttgttatttcttaaataactttccctttcatttttaaattataaatttaacttctaacatgttttatggttaaaattgtacttttttcctttagcgacattcaaatgcatcacaatcactttgtgaaattgttcgcctgagcagagaccagatgttacaaattcagaacagtacagagcccgaccccctgcttgccactctagaaaagtatgtgtaaaactctgttcttgttcttctttcatattgatgctgttccatgtgttaccattgtgagtggttggtaagtgttccttatgtgggaatcatgtgccttgaaaataaccttgggtgggtgagaaggtagggaaacctgcttcttttatctcaagtaaaagttttggcagggtaaagaagataaatgacatttatatctagacttttgagttttccaattatttggtaaaaatgggaaattctgtagaagcccttccttaaaaatgggggaagtccatttnanaaaattaactggtaggtca

SEQ ID NO: 536 - DNA, 372 bp, Homo sapien
  misc_feature (1)...(372): n = A,T,C or G
gttccaaccttcatttctgaaactgttctagagcacngtgtctttctcgtagttcataacttaccccttcagtctagaattagaattacattatctgttttactactttactagactgtaagctcctagaagataaggactagggagttcatctctgtattccaccagaaggtacagtgactcatatctagagtctttagatgaaacttactgagttgaataacttaatatatttctgttttcattcccaagggaggccatgtctggagatagaccttgaatttaataaattttaggcactataccatttcagtggagaaaattgttgggaaatttggggggatggatatataagggggaggaagtcactgg

SEQ ID NO: 537 - DNA, 284 bp, Homo sapien
  misc_feature (1)...(284): n = A,T,C or G
ccttctgatgcaaacagaaaggaaatgttgtttggangccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttgg

SEQ ID NO: 538 - DNA, 293 bp, Homo sapien
gtacatagtaggtgtatatatttatgggctatataagatgttttgatacaggcatgtaatgtgaaacaagcacatcaacaagaatggggtatccatcccctaaaacatttgtcctttgggctacatgtcatttcctaatgtaaagaaaatggacagacagaaccaacattgatttgactgggtgaaaaagtccatttgagttgggagcaggggttgtgttcctggatttgggttgttaggacagtgtaaaaaggcttcacaggggaacattcttttctgataaaggaaagcag

SEQ ID NO: 539 - DNA, 468 bp, Homo sapien
  misc_feature (1)...(468): n = A,T,C or G
tttcnataaactttatttttagagcagttttaagnnggtagcaaaattgattagaaggnacagagatgtcccatacacctcctactcccacacatgcacagccttccccattatcaatagcccccaacagagggatacatttgttaacaactgacgaacctacatatcattatcacccaaagtccacagtttatattattccttctggagaattttcaaatacagaaattcctctaccaggaataaactancaatttcctctcggctttctataaatttaattattatttcagaaattagcctatctttacaggagaaaatgttataaaccatgaaaagactatcaaatacacaaggaagtgaatgntatataaaaaatgtaccatctcctaaacaactacctgcattcccttcttgttggtaagttataatttgnnatagttctgatcatctgtttaattaatttgc

SEQ ID NO: 540 - DNA, 397 bp, Homo sapien
  misc_feature (1)...(397): n = A,T,C or G
ctgttttattaattcccccatttgcagcacacttntctcttccaacattcatcagtcagatcagagtccacggtcttttcaaaatttagataaactggcttacattttgtaatgatgtccccagacaacaccccactccaacccattctgtttgttactattagtttacaacatgcatgtgcctttactttcattttcatagtatttaaaaatggaagggcactcccaaatttactttaacccctttaataatctctctcctcctgctctctctggtcctccagacaactgttgatttactttcctttatgatggattagtttgcattttctagaattttatatgactgacatataaagnttttatgtttctcccctttgggtttcttcatgtggca

SEQ ID NO: 541 - DNA, 248 bp, Homo sapien
cctagataggggattgtgcggtgtgtgatgctagggtagaatccgagtatgttggagaaataaaatgtgcatagtgggggttttattttaagtttgttggttaggtagttgaggtctagggctgttagaagtcctaggaaagtgacagcgagggctgtgagttttaggtggagggggattgttgtttggaagggggatgcgggggaaatgttgttagcaatgagaaatcctgcgaataggcttccggc

SEQ ID NO: 542 - DNA, 366 bp, Homo sapien
  misc_feature (1)...(366): n = A,T,C or G
aatcggccctctagatgcatgctcgagcggccgccagtgtgatggatatctgcagaattcgcccttgagcgatancgcgggcaggtccaattgatttgatggtaagggagggatcgttgaccncgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactatgagggcgtgatcatgaaaggtgataagctcttctatgataggggaagtagcgtcttgtanac

SEQ ID NO: 543 - DNA, 460 bp, Homo sapien
cctactatgggtgttaaattttttactctctctacaaggttttttcctagtgtccaaagagctgttcctctttggactaacagttaaatttacaaggggatttagagggttctgtgggcaaatttaaagttgaactaagattctatcttgggcaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccaggtttcaatttctatcgcctatactttatttgggtaaatggtttggctaag

SEQ ID NO: 544 - DNA, 116 bp, Homo sapien
  misc_feature (1)...(116): n = A,T,C or G
ccgccagtgtgatggatatctgcagaattcgccctttggagngctngcgcccgggcaggtctgtttcagcagctcctccttcttcttcccgcgangatctcgagccttgatcttgg

SEQ ID NO: 545 - DNA, 380 bp, Homo sapien
  misc_feature (1)...(380): n = A,T,C or G
cgacggatcgatnagctngatatcgaattcggacgagcatggcgtattgctgcagatatggattcttcagaatgctccatgacaaatgtactgacgggaagncnatctaaaggaggcattgtnatgagagaaaggtctcgagctccagataaagagagatacagagttcttggaattggagttgcagaaacagtaagacaatcgattgtggggaagcgttcttttagagaatctttggccttcactccaaagcgttgttcttcatcaataataagtagctcgtgccgaattcctgcagcccgggggatccactagttctagagcggccgccaccgcggaggagctccagcttttgttccctttagtgagggttaatttcg

SEQ ID NO: 546 - DNA, 418 bp, Homo sapien
ccagggcaattaggcaggagaaggaaataaagggtattcaattaggaaaagaggaagtcaaattgtccctgtttgcggatgacatgattgtatatctagaaaaccccattgtctcagcccaaaatctccttaagctgataagcaacttcagcaaagtttcaggatacaaaatcaatgtacaaaaatcacaagcattcttatacaccaataacagaccaacagagagccaaattatgagtgaactcccattcacaattgcttcagagaataaaatacctgggaatccaacttacaagggatgtgaaggacctcttcaaggagaactacaaaccactgctcaaggaaataaaagaggatacaaacaaatggaagaacattccatgctcatgggtaggaagaatcaatatcatgaaaatgg

SEQ ID NO: 547 - DNA, 172 bp, Homo sapien
cctgaggttgggagaaattttgtccatttctttagaaccaaaattggcaaccagagagtatttggatgttacacaaaatatctagtttccctttctagcctaaattgggttgtttatagcacccgtctctccatttgagaaaaatggttaggatgctggtgcagggatgagg

SEQ ID NO: 548 - DNA, 367 bp, Homo sapien
  misc_feature (1)...(367): n = A,T,C or G
ggtctgacttaagagaaacaatggaaggcaagaggcagtagaataatatattcaaaagatgcaaaggaaaaaaacctctcagccacgaattccttatccagcaattatttttcaaaaatgaaaataacacaaagacttagccagataaacagaaacattaactgaagttgttgctggcagacctaccatataaaaataaaaaactctaaaaaaattcctatggctaaaagcaagttacagaagacagtcacttgaatccacattttaaaaaaagcactgatatacgtaatattgacattataaaagacagtaaaaatgcatttcttctttataataaatngcttattaaataacatgtgtataatgg

SEQ ID NO: 549 - DNA, 418 bp, Homo sapien
ccaaatcagaacctagagtgagcattctataaactcacctttgctttgatccttgaagatcacaagttttgatactgttgaaatctctactctttcaacactttaattaaatggcatttagaatttcatatacttctgttgttgtttccacaatcttaaactggatttagaaatacttataatgtaaatgcaagagctttaacttagtaaccgtatttcctattttttgttgtttttcttttgccagaatttctgtttgtctacaataaagtccagcgaaatacagtatttggttaggttacttgttaacataaaattttatcatttgtagagtttttacttaaccttcctattctctagtctctataatctttcaatgaagataaccagttacgaatatctcctataccatattagg

SEQ ID NO: 550 - DNA, 234 bp, Homo sapien
  misc_feature (1)...(234): n = A,T,C or G
cctacccgccgcagnactgatcattctatttccccctctattgatccccacctccaaatatctcatcaacaaccgactaattaccacccaacactcacaacaaaactaactaatactaacatctcagacgctcaggaaatagaaaccgtctgaactatcctgcccgccatcatcctagtcctcatcgccctcccatccctacgcatcctttacataacagacgaggtcaacgat

SEQ ID NO: 551 - DNA, 542 bp, Homo sapien
  misc_feature (1)...(542): n = A,T,C or G
cacccctaccccnntcctcataaaagttnctctccctggatcctctttttccctcatgagtgcccggttgcccaagtcaaaaacctgggagtgatataaactccccacacatccagtcagtcactcatcaactctattgattctgtctgctaaatatatntcaattgtattaacttaaacatatgcatanggcactttcttcttcactgcatttttgtgggctgcacttacctttcaggtaacgacaacactggcccctcttgcccttctagtcagaagtgccaaaatgatgagagctagccatgacaaacccacagccaacattacactgaatgtgcaaaactggaagggcatccaaacagaggaggggagagaggaatagacaggaagtcaaactgtctctgtttacagatgacatgtttctatatctataaagccccatagtcttggccccaaagcttcttctgctgataaactttagcaaagtcttagcatacaaaatcaatgtgcaaaaattactaacagtcctatacatcaagtca

SEQ ID NO: 552 - DNA, 411 bp, Homo sapien
  misc_feature (1)...(411): n = A,T,C or G
cctggntgacaaggaggtgcctgtnatgtgaagatttgaggaaagagcattccaggcagggggaaggcttgatgcaaagggtctactgcaggcattagctgagcttatttaaagatcagaatgaaggccattgtggctagaacagagtggacaggaaggaatggtaccaggcaaagctgaagaagttggcaggattgagctctcataantcatggcaaagagttcccatttcattgtttgacggaaataaattggaaggtcttaagtaggagaagatttgattagatttacattttacgaagaagcactctggatgttatgtgaagaaatggcctttgcagggcaagggtggaaacaaagagatcagttaggaaattattggagtagctgaggattggatgaggggatgtg

SEQ ID NO: 553 - DNA, 631 bp, Homo sapien
  misc_feature (1)...(631): n = A,T,C or G
ccgggattagaactaaaacaagtgagatcacccctctaattatttctgaacttggttaataaaagtttataagatttttatgaagcagccactgtatgatattttaagcaaatatgttatttaaaatattgatccttcccttggaccaccttcatgttagttgggtattataaataagagatacaaccatgaatatattatgtttatacaaaatcaatctgaacacaattcataaagatttctcttttataccttcctcactggccccctccacctgcccatagtcaccaaattctgttttaaatcaatgacctaagatcaacaatgaagtattttataaatgtatttatgctgctagactgtgggtcaaatgtttccattttcaaattatttanaattcttatgagtttaaaatttgtaaatttctaaatccaatcatgtaaaatgaaactgttgctccattggagtagtctcccacctaaatatcaagatggctatatgctaaaaagagaaaatatggtcaagtctaaaatggctaattgtcctatgatgctattatcatagactaacgacntttatcttcaaaacaccaaattgtctttagaaaaattaatgtgattacaggtagagg

SEQ ID NO: 554 - DNA, 558 bp, Homo sapien
  misc_feature (1)...(558): n = A,T,C or G
ccaggntagtctccaactcctgaccttagctgatccacccacctcggcctcccaaagtgctgggattacaggcatgagccactgcgcccggccaaacttgatatgcatttttaaataagttaatacattattcatggtttagtctcattatatattctatggtccactttgaaatttcatctaaccaaaatcatcttcatcctgcaatttgaggtttggacacaatggggattgatcagtaatttcttcatatgccctttctcaaggaaatagtttcctatgaaaaaaaagtcctatgttttcatgtaagttctctttttggagaagaaaaggagacattcttacttagcactctcagttttacaaaacgctgccaaccttaaaatttgtctattgattcccaaggcacacaaccaatagtctgtcaataacccggaataacatttctttaaggccccagtaactttcacatgtttgggttccaatcctcacctagaatcttgttaagaaaagtaaaccattcactcctctagaaactctaaggttgcttcttagggg

SEQ ID NO: 555 - DNA, 212 bp, Homo sapien
ccaggtatttgcataatggcttttcttctgttgcctttgttcctttgtggccccagctaattgcctgagagtgccactgttagttttcaactctttctgatagaaaccctgtgtactaacatggaaatcttaggtaatctgctttttcaaagcacaatgcagaatttattggcggtggtgtaactttaagaatatccgagaagccaccaagg

SEQ ID NO: 556 - DNA, 219 bp, Homo sapien
  misc_feature (1)...(219): n = A,T,C or G
ccatgtgtctatctggagagaaggggaaacagcaagtgcaaaggccctgagatggaacatatctggagaattcgaagaatggtaagaaggccagagtggagcagaacaagtgtgggagagagttgtaggagatgagatcaaaggctaggaatgaagtgtaaggccatgtcatgtgaccttgtatgtccttgtaaggcttttttttttttttttnancct

SEQ ID NO: 557 - DNA, 482 bp, Homo sapien
cctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccaggtttcaatttccatcgcctatactttatttgggtaaatggtttggctaaggttgtctggtagtaaggtggag

SEQ ID NO: 558 - DNA, 679 bp, Homo sapien
  misc_feature (1)...(679): n = A,T,C or G
ctgtnaaaattctgaacctatccccaaaagaaaaaccgtgaaatacaagttttaggaggtggagcaaagaaaagccaagttatttaaaaccaataaacacaagagacaattctgctggagaatttactttctccaaaacatcaaatggactttaaagcagaagaccacattttatgagaaagttatgtcactgaaaagcttcatgtaaagtgactttgtaaatggaatatttttaaatgataaaaagaaaataacttttccaggaatcctttggagaggctgataaccagatattaaattatcaattttgccaaagtggacttttaaaaaatgtgttacttttaaaaactaacttgaaagaatttatgaggcaatctatctgagtatgtttattgttgctccattggctttcaggattttggtcatttcactgttaactcttacatcagagaataaagaaaagaaaatgaaactttgttaggaactgggatggaaaatgtagtcccagacagatctactgacctcgactgagtttcagaaatatcccaggattttggttattcatgcctttcttttgtgactttctttcaaattagccaattaaagataccccttcaatcaccggtgacatcagtacaacagtttttcaacagttttctctctcctgaccaaacagttt

SEQ ID NO: 559 - DNA, 488 bp, Homo sapien
  misc_feature (1)...(488): n = A,T,C or G
ccccactgtactccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaacaagggctgtttttgctgccccaaaagggcttaacaatttaggcggatagtttacttaaaaaaaaaaatcctttggagacatactgaaaatgcaaactagtttctaaattatcaattccctacatgaanaagcagtttgccanagtttagtctcanaaaatgactggttggctctatttaaatcanaacccaatttctacgcacctgcccgcccggccaagggc

SEQ ID NO: 560 - DNA, 602 bp, Homo sapien
  misc_feature (1)...(602): n = A,T,C or G
cctanttaagaattccttgccttagtggtgaacaaggactaaacacagacaatgggtgaaacacagacgctaattcacataacagagagtaggcaaccttaagaatgaattgatgcagactcctatagaattcctctgttatgactgggttcttattttctcctccttgtatgtagttgaaatttcatcattatgaatagttccttggatctttttttaaagttgtgaatgcgagtgtttggctttgtaatacaactttttagtatccagaagataaccagtgctctaccaataaagatcttttgatacaaagggttttaacttctgccagttcttactcatttttttcaggttttttatacatttcttaaacaacacatacattatgtaaaatataagaattaatgtacattctcaaggccagattcagtgacaaaatgcactacccgaatctagtaacacatttactccttgctgcatataagtggcgtgtaagaaatacagggtatattgttttgtgatccatgcagtaaatgttcacaaatatcaggcaaacaactagacgntcttcagctactaaaattaactgtcccagtcacaaa

SEQ ID NO: 561 - DNA, 683 bp, Homo sapien
gtctatttttaaaaagaaagaaaaaaaccacttttttatagtccctagctttgccatatgcccgccttaagtggaaggaaagttaatcacttaactatgttttataaaaagaaaaaagggcttggaatgctattactgttcacacaaagtatgattctgtttgaataaggcaaatgctcctttttttaaaaaaagacattactgtaatatcaaaaaccgtggcagtttgtatacaactctgggcttgattttttttaaaaaaacagaatgaattgatgtcttattttataaatgttctatatttattaggagaaaactttatattgccttttttatcaatcatgtaacaggcttatagctttccaacagagctgcttgccaaacaattttttttgtttattaaacagtgctgaaacaaacaggatcagcatttacttaagatgttaagaatgaggacttttaatcagccgaaccaagatattgttacctgtatgcattcccaaagtctagatgctcagtatgttcagtcatatctttcagaatcagtgaaccgattaccctttttttggtattcactctacatctgccaacctagttcaccttggttttgtgtctgctgtagaagggaaccataacttggttaaaccgtagggattatcattgtatacatgctgtgaacatgt

SEQ ID NO: 562 - DNA, 420 bp, Homo sapien
gcactttttttccagtaaggattcatctcttgctctcctatatggtcattatattttatattttacatatttataaacatgacatatgtatttatgttccacaaagggctttgaatagaatttacacatagagttccctgggttgatgtgtttatcaaaatggaagataaagtgaattaattacttaaatatttaacactattgaatagaaataatttccccaatattgcttcatgatttagacagtctattaaatgtttaagcaaggcactagactaagtttattaagacaaattttggaatatgtgcagaaatatgacctggctaatagtacagagtcaaagctggttgaatggtgttatatagtggattcagattgatgtggcagtggtggttacactaggggcactaaggttatcc

SEQ ID NO: 563 - DNA, 482 bp, Homo sapien
ctccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgggcctggtgatagctggttgtccaagatagaatcttagttcaactttaactttgcccacagaaccctctaaatccccttgtaaatttaactgttagtccaaagaggaacagctctttggacactaggaaaaaaccttgtagagagagtaaaaaatttaacacccatagtagg

SEQ ID NO: 564 - DNA, 302 bp, Homo sapien
ctggaagtgaaggtactaatatacaaatggctcttgtttctgaatatgtgatataatttgtgaatctttggaaactgaattttttctatggagtgcaaatatagaagggttattttacaatgtttgttgtgaaaagaattcactttgtaaacaactattaaggctggaagtttagtgaaggtgcatagttttgaaagctacacaggtgaaaaatcaaacttattgtttgtaattttgctgttacatgttaagttactttgacagcaattttctaatgataatgtgatttatgatttaaaagg

SEQ ID NO: 565 - DNA, 554 bp, Homo sapien
  misc_feature (1)...(554): n = A,T,C or G
ccanngtgacatcatggcaatacagcaagaattctgnnatttatttagaagcctcaaggagaaggatcctggagcccctgaatgagagtttcttctccatgcctctccccagtcaaaatacatggaaatattcatagaagcattgtacccagcatgataaggaaggatggagaatggttccttatatctctgttcacaagacatcaacactcttaagtaactgtatgaaataaattctctgctgaaagcaaataaaccatctgaaaggtcttctggttacttacacagatttcctagagaatctgaaatcagcctaacagggaagattaatttttaaatgaatccaagttaatgaaagcaaagaactcttatacagaaatacattttcctattataaagcaggactaccttccctaatttctgatagacctaggacaatttgaatgggcattgaaattcttttggttgaattacgcaaacaagcaaaggaaaagtctcaattattattggaaaatttggggagagattattatctcttgatctcctagtnnatt

SEQ ID NO: 566 - DNA, 631 bp, Homo sapien
  misc_feature (1)...(631): n = A,T,C or G
ncgaagctgtgaanncattcacacggaatctgganggtattactgtaacttcttataatacataatataaaagtttttgaaagatatagacacaattaacccctaaacaacacactatctgattctcaaaagcaatggctatttaacaagatgtaaaaggacaataacatatcaaagaactttcacacacctaaagatagcatttagcagcaagttagtcagacaaaacaaacataaatatcttcacatttcctatgtttgtttttaactttacttcataaagccactgataattgaggtttctttcaagtataagatttctaaaattaaaaactgtttttgacatatttttataaagaaataaaaagcaaaacgcaatccaactatttatatgagtccctcttctccaacagctttagatgtttttctgagtactttttacacagaatatttttattaaaatcagttctaattcatttatgcagattaggggaaaatgattcataataaattaactttaaaattaccttctatctgcttctacctctatccccccatcaccaccaaatctgttgctacagtgaactgtagccaatgtctgtttgagggggcccaaagcatctggtaatct

SEQ ID NO: 567 - DNA, 510 bp, Homo sapien
  misc_feature (1)...(510): n = A,T,C or G
cctatnatagcttctctagctatcatactccaatcagcnaaaaatgagaaaatgttgagaaatagaagataattcctcatttaaggncaccttctanaatttgtgcttaanantctgttttcttctcatgggccagcacttcggcaactgggaaaaattangngtacagggatctaggnaatactgtttatttgagcaataatatattgngctaacgttcaggcatcctattactgagaaataagggaaaatgagtgtaaagtacaactaagagtctcggctacagggaaaaataccatcagttaaatatccatagtcctagagcatttatgtaaaactgcaatttgaatcctgcaatacattttggctttttcctcagtgataccatgtgtgggaagttgttctgtcaaggtgggtcggataatttgccctggaaaggacggatagtgactttcctgacatgtaaaacatttgatcctgaagacacaagtcaagaaataggcatggtgg

SEQ ID NO: 568 - DNA, 180 bp, Homo sapien
  misc_feature (1)...(180): n = A,T,C or G
ttaatntgacncacgcttatgcggaggagaatgntttcatgttacttatactaacattagttcttctatagggtgatagattggtccaattgggtgtgaggagttcagttatatgtttgggattttttaggtagtgggtgttgagcttgaacgctttcttaattggtggctgcttttagg

SEQ ID NO: 569 - DNA, 237 bp, Homo sapien
ccaattgatttgatggtaagggagggatcgttgacctcgtctgttatgtaaaggatgcgtagggatgggagggcgatgaggactaggatgatggcgggcaggatagttcagacggtttctatttcctgagcgtctgagatgttagtattagttagttttgttgtgagtgtcaggaaaagggcatacaggactaggaagcagataaggaaaatgactatgagggcgtgatcatgaaag

SEQ ID NO: 570 - DNA, 352 bp, Homo sapien
ctgtctctccatttagagccccagttggtcctgacctcttacaaatttggtgttttcactttgatgtttatgaaccgattgcattaaaaatgcaggataatgattcagggttagagaaactattatttatacaaatgtggttaacacctcatcattttaaattggctgtgctaataatgctcattgtgctcttcagggttatgtgtgtgtgtgtgtgtgtgttttgcctgaatctgcaacctacatttgctctggcagtatgttgagtatatgctagaatagaatggacctaggcaactctaaggtcctacaactaaatacacttacttaggaaacctcctaaataagtagg

SEQ ID NO: 571 - DNA, 402 bp, Homo sapien
ctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttgtttctaccttgaggtcttttgacatgtggaaagtgaatttgaatgaaaaatttaagcattgtttgcttattgttccaagacattgtcaataaaagcatttaagttgaa

SEQ ID NO: 572 - DNA, 70 bp, Homo sapien
  misc_feature (1)...(70): n = A,T,C or G
tggatccgagctcggtaccaagcttggcgtaatcatggtcatagctgtttcctgtgntcgttttacaacg

SEQ ID NO: 573 - DNA, 423 bp, Homo sapien
ccaatggtttcttagtgaaagagtacactagctctgaatgcaatgccctcagaaagatatcattcatagagacatacaaagcacatggcaacatgacattggaatacacgattctgagcatcttcattcatgaccaacctggctatagatttcagatgtcctcttggctcgaaggatatctgggatatccatgctcacttgcattcctttccctttaatttcattttctaagtccttcttgtattgtttctaaaagaacagaaaataatcttggagctttgcttaagctttaatagcgatgttgaaatttacatgtttgaatctcaaagccacccatgtggaaagaaaacttatgctctttccagctatgattcacggcatttattttaaactttgtatcttgctgctgtcttacctggctgg

SEQ ID NO: 574 - DNA, 129 bp, Homo sapien
ctgttaaaagaacaaacttagcaatatataacagtttgctaacaggatttttgactattcactttgcgagttatttttaaaaatccacttttttactgagtcttactacataccaggcactgtacttgg

SEQ ID NO: 575 - DNA, 684 bp, Homo sapien
  misc_feature (1)...(684): n = A,T,C or G
ccagatntgacttttcaaaactactcacattgtgaaaaangcaggaacaaatctagtttcaagttcagcatgccgttccctgtttaattcataaaacacaactggcagaagtattacttgaagcaaaacaaaagtaacgtgggaacttgcttatttgctaagccacaatgtatttttccaggaatagcataaatttgccatctttcttgtgtctatggaaaaggggtttagaattgtttcactaaaaattaaatttctatattgtcaaacatgattgtatactcaaattttaaaatgtgaagggaacacttactaagcatttcctgggtatgccactatattaagtcctagtaatatgatatagtttatttcaattttttttcaactcatacttcctttaaaatagcactgaccaaaagaaagttaacatgagcttcatgtacaatttttaatctttttgcagaaaaataaactgagaaaggctaaaattgttttatttaagccactataccaagacatattgatttcaccaatataaaaattgagatagtttacattttttggtacatctttaaaatctggtatgtatttttatactgacagcacatctcaatttggacaagctacatttccagggctcaatagtcaccatgaatctcaattgtaatcaaagaggttggcctg

SEQ ID NO: 576 - DNA, 134 bp, Homo sapien
ccttatttctcttgtcctttcgtacagggaggaatttgaagtagatagaaaccgacctggattactccggtctgaactcagatcacgtaggactttaatcgttgaacaaacgaacctttaatagcggctgcacc

SEQ ID NO: 577 - DNA, 133 bp, Homo sapien
  misc_feature (1)...(133): n = A,T,C or G
ctgtctctccattnagaagccccantnggtcctnacctcttacaaatttggtgttttcactttgatgtttatgaaccgattgcattaaaaatgcaggataatgattcagggttaganaaactattatttatac

SEQ ID NO: 578 - DNA, 200 bp, Homo sapien
cctcaaatctatcttcaaaggtgacccagcaatcagtgtcaatgcctttactgtagttaacctggtaatttcattctttagtctctccaagaaaatctgaagtgtattaggcaagtcagaacccaaattgtctccaaggttgcaaataatttgtcccatacaggaaatagccctttccttgacttcctgatcaatgtcag

SEQ ID NO: 579 - DNA, 402 bp, Homo sapien; identical to SEQ ID NO: 571

SEQ ID NO: 580 - DNA, 245 bp, Homo sapien
  misc_feature (1)...(245): n = A,T,C or G
ccaattgatttgatggtaagggagggatcgttgacctcgtctgttatgtaaaggatgcgtagggatgggagggcgatgangactaagatgatggcgggcaggatagttcagacngtttctatttcctgagcgtctgagatgttagtattagttagttttgttgtgagtgttaggaaaagggcatacaggactaggaagcagataaagaaaatgactnttagggcgtgatcatnaaangggataaa

SEQ ID NO: 581 - DNA, 294 bp, Homo sapien
tgcagcgcaagtaggtctacaagacgctacttcccctatcatagaagagcttatcacctttcatgatcacgccctcatagtcattttccttatctgcttcctagtcctgtatgcccttttcctaacactcacaacaaaactaactaatactaacatctcagacgctcaggaaatagaaaccgtctgaactatcctgcccgccatcatcctagtcctcatcgccctcccatccctacgcatcctttacataacagacgaggtcaacgatccctcccttaccatcaaatcaattgg

SEQ ID NO: 582 - DNA, 230 bp, Homo sapien
gaggtcgccctcatagtcattttccttatctgcttcctagtcctgtatgcccttttcctaacactcacaacaaaactaactaatactaacatctcagacgctcaggaaatagaaaccgtctgaactatcctgcccgccatcatcctagtcctcatcgccctcccatccctacgcatcctttacataacagacgaggtcaacgatccctcccttaccatcaaatcaattgg

SEQ ID NO: 583 - DNA, 481 bp, Homo sapien
ccaagggtgttctgcctgcctcagcctcccaaagtgctgggattacaggtgtgagccactgtgcctgaccacaggaaaacttatttaaatgagagatttgactcgaaagatcccgtttttttaaggctcttagttcttaaaagcggcacataatagaattagtataatcccaaataaattttcagtagatttttggtgtaacttgagaagatgattctgtcatttttagtgacaatttaaaagacctgaaattgtctacagccatagaaagtgaactactgatagttgtttctgtaaagttttattggaacacaaccacacctatttgttcatctgtattgtctttggttactttgtgcagagaccatggcccacaaacctaaaacattcactttctagctctttaagaaataattggcccactgacaccctggtcttaaggtctagaccaattatttctcaagagtattagctgaatcag

SEQ ID NO: 584 - DNA, 306 bp, Homo sapien
ccaattaagagctaaatttacaaaataatctctatcaggaggctttaaggtttaatgtctctaaagtccctatggatataagaggcttgaatgtactgaattcaaatttggtttttaaatgttataatagtttaggcccgagagccacatatttctgtctaagaatagaaagcatagctagctgcccacacagaatattcatatagaggtggggggcaagaacaaaatttattcatttgatacatagaaatgggactacttagaatagactcataatagaaagcatcatctggtttctcatctcag

SEQ ID NO: 585 - DNA, 308 bp, Homo sapien
ccagaatggtacagagtggagggtgttctgctaatgacttcagagaagtatttaagaaaaacatagaaaaacgtgtgcggagtttgccagaaatagatggcttgagcaaagagacggtgttgagctcatggatagccaaatatgatgccatttacagaggtgaagaggacttgtgcaaacagccaaatagaatggccctaagtgcagtgtctgaacttattctgagcaaggaacaactctatgaaatgtttcagcagattctgggtattaaaaaactagaacaccagctcctttataatgcatgtcag

SEQ ID NO: 586 - DNA, 416 bp, Homo sapien
  misc_feature (1)...(416): n = A,T,C or G
cctgtctttgaatggatgaaataggttaataaaaaacatcactgtttaaaaactagaacactgaaaaattctaggaaagcttattttcccttatatttttatggnactttcaacacttnacaacactatttnaattaanntttnttctagagtttatannatatcagtacattcttttctgtggatgcaataatatagaatcttattncaaatcttactggcaggntctnttaaattcttcaacggntgncatagtgattaaccaaaattagttatgatttctgcctatctgtgtgagaacttacaggggaaattgttctaaacctgaggaacatgaagtaactgtactgcacactccaaatgatgacagtcattttatatcaccttcaattacccaacagcttttaatagtctgg

SEQ ID NO: 587 - DNA, 382 bp, Homo sapien
cctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttc

SEQ ID NO: 588 - DNA, 307 bp, Homo sapien
cctactcttctccgtccattgtactatctgcccgtggtggggatggcagtaggatcatatttgatgacttccgagaagcatattattggcttcgtcataatactccagaggatgcgaaggtcatgtcctggtgggattatggctatcagattacagctatggcaaaccgaacaattttagtggacaataacacatggactaatacccatatttctcgagtagggcaggcaatggcgtccacagaggaaaaagcctatgagatcatgagggagctcgatgtcagctatgtgctggtcatttttggagg

SEQ ID NO: 589 - DNA, 89 bp, Homo sapien
cctgggtgattgaggatgcaatgagctgtgattgtgccaccacactccagcctgggcaatacagcaagactgtctcaaaaaaaaaaaaa

SEQ ID NO: 590 - DNA, 456 bp, Homo sapien
cctcagttcttgattgtggttgacggggcgtcaccatgaaggagcccatttagtataaagcttccaaccttttctcttaatcgtttctttaatcttttaaaccatcttcaagtgcataggggagtttccgatgccagaggatgaaagcaagtgctctctccaccctctcctcccagagtgaaaacaaatccttttgctgatacttgtttcaaaagcatccattgtaaagcttctcagtgacacaaaatactgagaggtaactttttatcaatcaaaccacataccccaatttaacacctttcaatgctctgaattcaactgacagactaaagggtgtttcctgtaacagtctgaaatattaagtgttttttttgttttgtttttaaatcttatttcagaaaacttcctcttggggtaggaaagtacacatgaagcagcaaagtaacgaagaaaaac

SEQ ID NO: 591 - DNA, 289 bp, Homo sapien
ccaattgatttgatggtaagggagggatcgttgacctcgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactatgagggcgtgatcatgaaaggtgataagctcttctatgataggggaagtagcgtcttgtagacctacttgcg

SEQ ID NO: 592 - DNA, 435 bp, Homo sapien
  misc_feature (1)...(435): n = A,T,C or G
cgcgttagatgcgccttttccggcctgtgcgtctgctctggttcctctcaggcagcaaagctggggaaggaagctcaggcaggagcctccccgacaccacagcggcacaagcagcagctaaagcaccgcactttgctctgctaaccttttacttaaatgaggttttgccaaatccacatctggaaccgcatcacacccatttgcaaggatgtttgttctttgatgaaactgcatctctactgcacatganggctttcattgtaggacaagaggagagttcgtttatttttgtaactgttttacatgttccgattanttaatcggnagcttatgtcatttgctatgcctgttgtcttctaatctctccttactaaaacattacttcaaatttnaattgacccttgtttataatttatttaacgggatttgngtgtc

SEQ ID NO: 593 - DNA, 633 bp, Homo sapien
  misc_feature (1)...(633): n = A,T,C or G
ctgtttagtcagataattgtgtccgaattgattangaaaataatagaccagccataaagcagcataaaatattatgaaactattccagaagttcagtaatatctttgggacctgctcatagcccaagttttgtgaatacttttgtagttaaaaaaaatttttactttaccagggcattgcaattcttttccatcagtgaatttcattctacagacttttcagagcatctcataatcagtcaacaaatctatttcaaatgtgtttgttactaagcaacggttgctaagagcttctgtaattaagatgaaagttccaaggtaacaatgcccaaacacagcaccattttcaccattttctgataatgcaggagtaggatggctaaaagtgaaagaagaatctactctatggaaagcatggcacctgaaatttctgaagatattggctgtcctctagcttatatgagagagagtgtttgtgctttactaatcaaccagtcatttttttcttgtgtggctgaaatgtacattccagacatgaacaggtagagtatgtgttgggggcaggtttatactgcatgggtgtgctgagacagggccacgtggtgatgtaaatgatgctgnctgacacgtgcag

SEQ ID NO: 594 - DNA, 501 bp, Homo sapien
  misc_feature (1)...(501): n = A,T,C or G
cctttacaagatgctggtaccttgatcttggacngggcaggctccaagatggaaagaaagtgagcatctgctttttagggattatccagtctatactactctgttctagccacacaaaacaggttaagacagaaattggtaccaagagtggggtgttactacagcaaatacctgaaaatgtagaagaggctttgaaatgtggtaattggaagaagctggtagaatttggaggagtaggctagaaaatgtctgtattttcatgaatggagcattaagaataattccggtgaggccatagggaaagtctaaaacttttcagaaattatgtaagcgattgtgattagtaggttggtagaaatatagacagtaaaagcaattctgatgtggtttcagaggaaaatgaaaaatattagaaactgaaggaaggggcatccttgctataaactggcaaagaacttggctgaaatgtctccatgtccaagagatttatggcagaaatgt

SEQ ID NO: 595 - DNA, 383 bp, Homo sapien
ctggtcaccatcatccctttaatcaactcacacctgtttaaagagtgtttctgatttgaccttcatcccttagtttactggcgttaaaaaaagtctcagcaattttcattatttctcgtgggtctcattatcaaacctttacttatttcggcatatttcctctgggcttcttctagtttctgccttacaagcaatgctgttctgtaaatttattgaaacctctggaacatttcacctttagagatggaggatggaaggattggtaccagaagagggctaagatacgttttctgtcttgagctgaaagcacagtctactctccttcgttttgtcgatgagaaagttgaggccagaggggaggtgacatgtttagagtcacccag

SEQ ID NO: 596 - DNA, 266 bp, Homo sapien
ccatggctaggtttatagatagttgggtggttggggtaaatgagtgaggcaggagtccgaggaggttagttgtggcaataaaaatgattaaggatactagtataagagatcaggttcgtcctttagtgttgtgtatggctatcatttgttttgaggttagtttgattagtcattgttgggtggtaattagtcggttgttgatgagatatttggaggtggggatcaatagagggggaaatagaatgatcagtactgcggcgggtagg

SEQ ID NO: 597 - DNA, 383 bp, Homo sapien
  misc_feature (1)...(383): n = A,T,C or G
ctggtcaccatcatccctttaatcaactcacaccngtttaaagagtgtttctgatttgaccttcatcccttagtttactggcgttaaaaaaagtctcagcaattttcattatttctcgtgggtctcattatcaaacctttacttatttcggcatatttcctctgggcttcttctagtttctgccttacaagcaatgctgttctgtaaatttattgaaacctctggaacatttcacctttagagatggaggatggaaggattggtaccagaagagggctaagatacgttttctgtcttgagctgaaagcacagtctactctccttcgttttgtcgatgagaaagttgaggccagaggggaggtgacatgtttagagtcacccag

SEQ ID NO: 598 - DNA, 266 bp, Homo sapien
ccatggctaggtttatagatagttgggtggttggtgtaaatgagtgaggcaggagtccgaggaggttagttgtggcaataaaaatgattaaggatactagtataagagatcaggttcgtcctttagtgttgtgtatggctatcatttgttttgaggttagtttgattagtcattgttgggtggtaattagtcggttgttgatgagatatttggaggtggggatcaatagagggggaaatagaatgatcagtactgcggcgggtagg

SEQ ID NO: 599 - DNA, 294 bp, Homo sapien
  misc_feature (1)...(294): n = A,T,C or G
ccaattgatttgatggtaagggagggatcgttgaccacgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcanataaggaaaatgactatgagggcgtgatcatgaaaggtgataagctcttctatgataggggaagtagcgtcttgtagacctacttgcgctgca

SEQ ID NO: 600 - DNA, 213 bp, Homo sapien
agatattgggctgttaattgtcagttcagtgttttaatctgacgcaggcttatgcggaggagaatgttttcatgttacttatactaacattagttcttctatagggtgatagattggtccaattgggtgtgaggagttcagttatatgtttgggattttttaggtagtgggtgttgagcttgaacgctttcttaattggtggctgcctttagg

SEQ ID NO: 601 - DNA, 471 bp, Homo sapien
  misc_feature (1)...(471): n = A,T,C or G
ncctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccaggtttcaatttctatcgcctatactttatttgggtaaatggtttggctaaggttgtctggt

SEQ ID NO: 602 - DNA, 482 bp, Homo sapien
  misc_feature (1)...(482): n = A,T,C or G
tgagcatacagcaataaaaataacataatttntatgtgtacaatatttatggaatacgttactggaacagataaataatttagttaataacatgacaaagaacagaaattgtatacactatacagcatagtaatagaataatgaatgattaaagttattaatattaggtagaaaatgaagggtatctttgagagcagaactcaaggaagcaagcaatttgccttatgaggaaagagttacctgtggataaaggagaaactgaaaaatttacaagtcaagactttttgagcaaaaacaaaaatatgactatgagtcaccaattcagtacagtgaaaaaaaagttgaagagatatcttggaagtaaaccatgttgtggaagagcagggttttgataatcatgggattattctgaatgaattttaaatgcgataggaatatatgagataatttcaccagagaataatatgatcatgtttgcattt

SEQ ID NO: 603 - DNA, 372 bp, Homo sapien
gttccaaccttcatttctgaaactgttctagagcactttgtctttctcgtagttcataacttaccccttcagtctagaattagaattacattatctgttttactactttactagactgtaagctcctagaagataaggactagggagttcatctctgtattccaccagaaggtacagtgactcataactagagtctttagatgaaacttactgagttgaataacttaatatatttctgttttcattcccaagggaggccatgtctggagatagaccttgaatttaataaattttaggcactataccatttcagtggagaaaattgttgggaaatttggggggatggatatataagggggaggaagtcactgg

SEQ ID NO: 604 - DNA, 468 bp, Homo sapien
  misc_feature (1)...(468): n = A,T,C or G
gcngttttgagtgagtttcttaatcctgagttctggnttgattgcactgtggtctgagagatagtttgttataatttctgttcttttacacttactgaggagagctttacttccaagtatgtggtcgattttggaataggtgtggtgtcgtgctgaaaagaatgtatattctgttgatttggggtggagagttctgtanatgtctattaggtccgcttggtgcagagttgagttcaattcctggatagccttgttaactttctgtctcgttgatctgtctaatgttgacagtggggtggtaaagtctcccattattattgtgtgggagtctaagtctctttgtaggtcactaaggacttgctttatgaatctgggtgctcctgcattgggtgcacatatatttaggacagcnagctcttcttgttgaattgatccctttaccattatgtaatggccttgnctcttttg

SEQ ID NO: 605 - DNA, 288 bp, Homo sapien
ccaattgatttgatggtaagggagggatcgttgacctcgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactatgagggcgtgatcatgaaaggtgataagctcttctatgataggggaagtagcgtcttgtagacctacttgc

SEQ ID NO: 606 - DNA, 572 bp, Homo sapien
  misc_feature (1)...(572): n = A,T,C or G
gaatnaaatgaatgaaatagaaaatataattgagagcttcaacaacagactataccaaatggaggaaaaaatttctgaacttgaagatagatcttttgaaataacacaagcagtggcaaaaatgaattaaaaagaataaggaaagcctaaaggatttatgagatatcattaagcaagcaaatattcatactatgggcattccagatggaaaaaagaagggtaaaggtgaggaaatcatatttaatgaaataatagcagaaaatttccggagtcttgggagagagatgagcatttaggtccagggagctcaaagaaccccaaacagattcaacccaaacaggtcctctctggagcccaacatagtcaaattgtaataagtaaaagacaaagaattccaanaagcattcaagagaaaagagtcaagtcataaataagggaatctccattaggctaacagcagatatctcagcagaaagcttacangccangagagaatgggatgatatattcaaagtacttgaaagcaggggtnggggaaaccctgctagctaaaaatattatacccttgcaaa

SEQ ID NO: 607 - DNA, 178 bp, Homo sapien
  misc_feature (1)...(178): n = A,T,C or G
ctcggggtaatctcccagcaagaggtcaggtcctggntgtgcgtcccagggtgtcagtgaaattggctgctcccctgacccagggcaccttcatgcgtcttcacagcaggactactgtgaccaaggccagacctttcatctttcaaaagactttgactaaaaatgctttaaaaaagca

SEQ ID NO: 608 - DNA, 416 bp, Homo sapien
cctgtctttgaatggatgaaataggttaataaagaacatcactgtttaaaaactagaacactgaaaaattctaggaaagcttattttcccttatatttttatggtactttcaacacttaataacactatttcaattaagttttctcctagagtttatagtatatcagtacattcctttctgtggatgcaataatatagaatcttattccaaatcttactggcaggttctcttaaattcttcaacggctgtcatagtgattaaccaaaattagttatgatttctgcctatctgtgtgagaacttacaggggaaattgttctaaacctgaggaacatgaagtaactgtactgcacactccaaatgatgacagtcattttatatcaccttcaattacccaacagcttttaatagtctgg

SEQ ID NO: 609 - DNA, 648 bp, Homo sapien
ctgatctctcagcagaaactcttcaaaccagaagagagtgggggccaatattcaacattcttaaagaaaataattttcaacccagaatttcatatccagccaaactaaccttcacaagtgaaggagaaataaaatcctttacagacaagcaaatgctgagagattttatcaccaccaggcctaccctaaaagagttcctgaaggaagcactaaacatggaaaggaacaaccagtaccatcgaggctaggaagaaaccgcatcaactaaggagcaaaataaccagctaacatcataatgacaggatcagattcacacataacgatattaactttaaatgtaaatggactaaatgctccaattaaaagacacagactggcaaattggataaagagtcaagacccatcagggtgctgtattcaggaaacccatctcaccgtgcagagacacacataggctcaaaataaagggctggaggaagatctaccaagcaaatggaaaacaaaaaaaggcaggggttgcaatcctagtctctgataaaacagactttaaaccaacaaagatcagaagagacaaagaaggccattacataatggtaaagggatcaattcaacaagaagagctaactatcctaaatatatattgcaccc

SEQ ID NO: 610 - DNA, 310 bp, Homo sapien
ccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttacacaaactgttttgaggctcttaccgtagtcgaaggtatcttagatcttccttagtgatctcattaagaatatccgaaagtgtataaccctcttcaacaatctgaaacaaagatcagatccttaagagctgagcag

SEQ ID NO: 611 - DNA, 254 bp, Homo sapien
  misc_feature (1)...(254): n = A,T,C or G
ctgtttttacatctaaagcaatagactagaactgaattntcttctacatagtaaaatcacaattgtggaattacaggaattctggtgatattaaggtgaaacaacaaaacacaaaaggccctattttaacagttgatgtgacagtaagttttaatagaacctgtaacttcattttggaaatgcttctccaccaaataaggcctttttcccctatttaaggagccagatggattgaaagatgtggaaataggcag

SEQ ID NO: 612 - DNA, 225 bp, Homo sapien
  misc_feature (1)...(225): n = A,T,C or G
ctgactatatcatgtcaccatcatagccaatacaacattnttgccatacttcctaaaaaccttttcgcatacactgatcatgctacttatcagcactttctaacatcctgaccaaacagacacccacacctcttatagagtacactgtgagagaataacatggacttgatatggcatcacacttgttttaaagcaaaaaaaaaagaaaaagaaaagaaaaaaaaa

SEQ ID NO: 613 - DNA, 471 bp, Homo sapien
  misc_feature (1)...(471): n = A,T,C or G
ccatcagacttcttgggtgcctggctatattcaatgtgaagtaaaaaatatcccaagtcttacaccaaaatagaggctctgacttagaagtatgcttttagctttctttttaaataagacattctggaagaaaaaaaaagaaaaaggaaagaaaatcaagtttgaaacacagttaacacttattttggcaagaaagcaaccaaaatctaaaaagcataaactatgngtccaaatgnaaaaggnattacagaacaaactgcaagaggggaaaattaaagccncactgaacgaaaaaatacagtatgtctaacattttggaattgnaatttaaaccctaagggcaaaagctgaaaaatcatgcttanacctnggncgngaccacnctaagggcgaattccancacactggcggncgttactagtggatccnanctcggtaccaagcttggcgtaatcctnggcatagctgttt

SEQ ID NO: 614 - DNA, 421 bp, Homo sapien
gttattttttagaatggctctcccatcttgagtatgtgtgatgtttcctcatgtatgaatgaagcatatacatctttgtcagaagtatcccagaagcaattctgtactctcctcattatgttctattgggtgggccatggtttttgatttgtctcattactgatgatggttacttttattatttgataaaggttgtatataacttatctattatggcataatacattagctaaaaccttggcggtgtaaaacagcagatacttacgtttctcataggaatggctctattgagtacctctgtctcaaggcttctcaagagtttgtagctaccttgttggctggggttgcggtctgacctaaaggcttagttagggggtggtagaaatcttccatatgttctttgctacgtggacctcacagg

SEQ ID NO: 615 - DNA, 242 bp, Homo sapien
cctcctatttattctagccacctctagcctagccgtttactcaatcctctgatcaggatgagcatcaaactcaaactacgccctgatcggcgcactgcgagcagtagcccaaacaatctcatatgaagtcaccctagccatcattctactatcaacattactaataagtggctcctttaacctctccacccttatcacaacacaagaacacctctgattactcctgccatcatgacccttgg

SEQ ID NO: 616 - DNA, 392 bp, Homo sapien
  misc_feature (1)...(392): n = A,T,C or G
cctaatttgtagattgtgaaagcagcttttagtttaacttatttacagaccccttataattaccatgtttttttttttnttcctaaatctnttggttcagcttgngaatnttacgtgcccgtaaagtngggatgttgaatnggcccttntttgttctggcagngagtcaagngtccancattttttcataagngttttttaaaatngttctccancattttatggctcctccctcccatgtcctcaaacccagcaaaagcgtanaggcanaattanaggacccncccgggcggccgntaagggcnaattccagcncactggcggccgttactagnggatccnagctcggnnccaagctnggcgtaatcatggncatagctgtttcctgtgan

SEQ ID NO: 617 - DNA, 215 bp, Homo sapien
cctactatgggtgttaaattttttactctctctacaaggttttttcctagtgtccaaagagctgttcctctttggactaccagttaaatttacaaggggatttagagggttctgtgggcaaatttaaagttgaactaagattctatcttggacaaccagctatcaccaggctcggtaggtttgtcgcctctacctataaatcttcccactatttt

SEQ ID NO: 618 - DNA, 433 bp, Homo sapien
  misc_feature (1)...(433): n = A,T,C or G
cttttgtntgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacccataatggatttggttaatgacttatgagcaagctggtttgg

SEQ ID NO: 619 - DNA, 259 bp, Homo sapien
ctgcagtgtccctttttatatcatgctagtgttgagacatacttgactaacttgggaacagttcgatatattgacaaccgtcaacttaagaaaatcaacagcttttggccccagcgtccaagtgaacttttcatggagtgcagaatctcaaatggacaaaatactttgtctttttaaatactgaaaatttaattattagtactatgactgaaagattcttcatggctaaaaagctctgcatcaaactcaattcaggagg

SEQ ID NO: 620 - DNA, 393 bp, Homo sapien
ccaccaaagccacacggagattctgtcaggcgctgagacaccacagccttttcaatcttagggaaagaaatcaagtcatataaattaatatcaacaggtaaggtcattgagcaattgtctttcaactgtctaagactttatcacttaagatcataaacacagaagcaggtcataaaaatagcttttcttaaggtttaggagaatttgtaggggcacttacttgataatctgaattttctagtcagaagtttaaataccaccttttaaaaacataaaatttaatttgtaacaagttattaacaaagcagtattgtcgaaagttttaagctttctcccaataatttaattacattaattaaatttttaccattctaatggttacaaagtaaccag

SEQ ID NO: 621 - DNA, 563 bp, Homo sapien
ctgacaatgataaaattatctctatatgggcaaacgcgtgctctttgtcgaagaagaaagcttcagcttcatgttccaggtgagttaattaggcaatgtatgaatgctaatatctctttcacatattttgcttaagatctgtcttaggactctcgtctggcccatatggttttccaagggcagaagggcctctttttgatgagaggcagttttcagtaactcttaaagtgataacagcaaaggagaggagagagaagagtaagacaaatcgaaacattcttcaattgcttcttggccttttggctaagctcaagctcaaaacaggtcttcaaggagaaaatacatcacaaagaaaaggatgttttatttcttaccttgtcctagaaaaatttccataaactctattggcttaattctgtaaacttgaccaatatcagagtgcttcctaccaaggagggtagctgatgagcgtgaccatggtacatcctagaagaatgtgtgatgaagaagctttcaccgtgtaaaagagttgaaaattattcaaggagacattatggtcttgg

SEQ ID NO: 622 - DNA, 505 bp, Homo sapien
  misc_feature (1)...(505): n = A,T,C or G
tcttaagtgtgtttaatagataaagtaaactttcctagtcaagggttagatttttattatctcttgtgttccgactttctacttttcaactttgaacttcaaaaaaacattactttgcttatcctttgtactttgatcaggttgtttagaattgtagatcaaaccattctttgatcattttattgtttaaatgnttagttccatttataatttttatagccaactctcggttatttctgtcttttgagattgcaattcagaagctgtatgtcgaagtaatttatgagttgacttttatacttaggcttctttaaatactaatagtcaagaattctagagcatctaataaaaaattaactttcagatcattgggaatctgtcctcatttaaatatgtgtaaatgcatttccacagcaaattgcttcatgccctttgnctataaggaaattattccttgtagctaatacatttttcattttgcagnccaaatcttttttgagaaagg

SEQ ID NO: 623 - DNA, 489 bp, Homo sapien
cctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccaggtttcaatttctatcgctatactttatttgggtaaatggtttggctaaggttgtctggtagtaaggtggagtgggtttg

SEQ ID NO: 624 - DNA, 233 bp, Homo sapien
gttggggaacagctaaataggttgttgttgatttggttaaaaaatagtagggggatgatgctaataattaggctgtgggtggttgtgttgattcaaattatgtgttttttggagagtcatgtcagtggtagtaatataattgttgggacgattagttttagcattggagtaggtttaggttatgtacgtagtctaggccatatgtgttggagattgagactagtagggctagg

SEQ ID NO: 625 - DNA, 459 bp, Homo sapien
ttcgagaacatttttaataaataatgtgacaaaattacttttctgattattggattttcagtatgcaaaattatggctaaaaataaggggcttcttacatgaacataatgaaaacattaatcacatggattgttcccttagtactgcacgccttttctatggaactttttcaaattatctaaatgaacaagtttggttttggtgaacaccagcctttttttttgtggttcagttttgtttggctttgtcttccactggggtcagacctgatacttatctatctatgaataaatgtacatttttttcttcaaatagcaccaattataaaatcaatgatattcataaaatgacaaaaaaggatcatagaaatctactagtcagagggcatcatttgtcaattgaaagcaagtaatgcctctattagagattttaaggaaatcttgtaggtttcgacattgg

SEQ ID NO: 626 - DNA, 458 bp, Homo sapien
cctgatgattgttttaaacagtagaaagggttcagctaagaactacagtccactctcagccctgtcatgtactataggacaagtcttcattcacaacaaatggatagcaacaccaatctcgtaacactgggaaaactgcatacaatatttagaaggaacactaatacagcagaatctgcacacaacggagtcaaagatctgaggccaaatcctactacactttacgactttgagttggtcacttttctgaaccttagcttctccatcagtgtaaaactgatgtaaaataatataaagctatatgaaagctgatgtgatttacttgtgaaatagtatgtgcaaaaggactttgtaaaatgtaaagcactatgctggttattgtgatatctgagatatttttaaagttgcaattcaattcaacaagcattcatttagagtcatgtgcaaggcactgtgct

SEQ ID NO: 627 - DNA, 393 bp, Homo sapien
  misc_feature (1)...(393): n = A,T,C or G
ccatnngaacgcactcaggaggtggtttgttctggatgcagaaaccagagatctagtttctatccacacagacgggaatgaacagctctctgtgatgcgctactcaatagatggtaccttcctggctgtaggatctcatgacaactttatttacctctatgtagtctctgaaaatggaagaaaatatagcagatatggaaggtgcactggacattccagctacatcacacaccttgactggtccccagacaacaagtatataatgtctaactcgggagactatgaaatattgtactgggacattccaaatggctgcaaactaatcaggaatcgatcggattgtaaggacatttgattggaccgacatatacctgtgggctaggacttccagga

SEQ ID NO: 628 - DNA, 233 bp, Homo sapien
  misc_feature (1)...(233): n = A,T,C or G
ctggatttataaaatagttgaatgacaaaagaagnntgttttgacagtaaaaaaaagacattatggacaaaatatgcaaaatgtgcaaagaaaaaataaatttgcattagaaaggtgggcatttgatctctgagccctgtgccatgtaacattgccatgttctttcactgttgtttgaatgttgtaccccancccttgactctggacttaaggcaagctatgactggctttgg

SEQ ID NO: 629 - DNA, 450 bp, Homo sapien
  misc_feature (1)...(450): n = A,T,C or G
ccnggacaatntaggcaggagaaggaaataaagggtattcaattaggaaaagaggaagtcaaattgtccctgtttgcagatgacatgattgtatatctagaaaaccccattgcctcagcccaaaatctccttaagctgataagcaactccagcaaagtcgcaggatacaaaatcaatggacacaaatcacaaacattcttatacaccaataacagacaaacagaggccaaatcacgagtngaactctattccaattgctttcaagaaaattaaaatacctagggatccaacttacaagggacatgaaggacctcttcaaggagaaactacaaaccactgctcaatgaaataaaagaggatacaaagaaatggaagaacattccatgctcattggtagcttgatggggatggcattgaatctataaattaccttgggcagtatggacctca

SEQ ID NO: 630 - DNA, 486 bp, Homo sapien
cctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccaggtttcaatttctatcgcctatactttatttgggtaaatggtttggctaaggttgtctggtagtaaggtggagtggg

SEQ ID NO: 631 - DNA, 211 bp, Homo sapien
tttacataaatattatactagcatttaccatctcacttctaggaatactagtatatcgctcacacctcatatcctccctactatgcctagaaggaataatactatcactgttcattatagctactctcataaccctcaacacccactccctcttagccaatattgtgcctattgccatactagtctttgccgcctgcgatgcagcggtagg

SEQ ID NO: 632 - DNA, 293 bp, Homo sapien
  misc_feature (1)...(293): n = A,T,C or G
cagcgcaagtaggtctacaagacgctacttcccctatcatagaagagcttatcacctttcatgatcacgccctcatagtcatttttccttatctgcttcctagtcctgtatgcccttttcctaacactcacaacaaaactaactaatactaacatctcagacgctcaggaaatagaaaccgtctgaactangctgcccgccatcatcctagtcctcatcgccctcccatccctacgcatcctttacataacagacgaggtcnacgatccctcccttaccatcaaatcaattgg

SEQ ID NO: 633 - DNA, 263 bp, Homo sapien
  misc_feature (1)...(263): n = A,T,C or G
nggtctgcagtgtccctttttatatcatgctagtgttgagacatacttgactaacttgggaacagttcgatatattgacaaccgtcaacttaagaaaatcaacagcttttggccccagcgtccaagtgaacttttcatggagtgcagaatctcaaatggacaaaatactttgtctttttaaatactgaaaattnaattattagtactatgactgaaagattcttcatggctaaaaagctctgcatcaaactcaattcaggagg

SEQ ID NO: 634 - DNA, 491 bp, Homo sapien
cctactatgggtgttaaattttttactctctctacaaggttttttcctagtgtccaaagagctgttcctctttggactaacagttaaatttgcaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccaggtttcaatttctatcgcctatactttatttgggtaaatggtttggctaaggttgtctggtagtaaggtggagtgggtttgg

SEQ ID NO: 635 - DNA, 270 bp, Homo sapien
ccaattgatttgatggtaagggagggatcgttgacctcgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactatgagggcgtgatcatgaaaggtgataagctcttctatgataggggaagtagcg

SEQ ID NO: 636 - DNA, 383 bp, Homo sapien
cctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcc

SEQ ID NO: 637 - DNA, 537 bp, Homo sapien
  misc_feature (1)...(537): n = A,T,C or G
ttttaatcctggggtatataggcagnactttaaattgcaaagtcttccgggcctattttcctctacatttttgtaattaactctgggggcttacttgttttggcagtactgaaatcaaaggagctggttcttcttttctcccaattattttcatatgaaagcacctacaattagcctgttagtcctattcagatacatcaaatatcagtgaatgctttactattcgcacatttaagcatctttgttttacataaaattagagtatgaaaaccagtgttcaattttttatcttgttgagcttgtaaaatgccagcaatttaaaactaggacttttccccccataagccaaggaggtagaattactaatacaagggttaaagaaggtagattttgttttcaatatttgggtaatattagaaagattcttcccacagggaagaactagcaagtgtcccaattttttccaaacgttggggaggggaaaattcactgtatcatgaaaccctaagggtttgngtgcacttcctgctttttagg

SEQ ID NO: 638 - DNA, 445 bp, Homo sapien
  misc_feature (1)...(445): n = A,T,C or G
ccagcagaacacagnagtgatttggtcccgtttgttccccagtggggtatctatccttgtgcagggcacaagcctacatggtggctctggtcatatcattagaaaatagacagaaatgggctgcacaccagaatgaatgaattgaattgaaagggaggagtgatggtggaaaaaaaaacaagtcaattcatttagactggtagaaccagaaccactgtgtagtacatccaaacggttaaaattccctggaagatgttacataatcctatcatggtgtttatttatggaaatctattttaaaaattttatgtaatactgcacagtctgtttgcatgatgccttgtacgtagtagcaactcagtaaatactttttgaatgaactagtatagtattttaattagctagtcttcgtgtactggtacaaaagaacagtgtcatcttacag

SEQ ID NO: 639 - DNA, 584 bp, Homo sapien
gcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcaagaggtggcgaaacccgacaggactataaagataccaggcgtttccccctggaagctccctcgtgcgctctcctgttccgac

SEQ ID NO: 640 - DNA, 404 bp, Homo sapien
ccataggaacgcactcaggcaggtggtttgttctggatgcagaaaccagagatctagtttctatccacacagacgggaatgaacagctctctgtgatgcgctactcaatagatggtaccttcctggctgtaggatctcatgacaactttatttacctctatgtagtctctgaaaatggaagaaaatataggagatatggaaggtgcactggacattccagctacatcacacaccttgactggtccccagacaacaagtatataatgtctaactcgggagactatgaaatattgtactgggacattccaaatggctgcaaactaatcaggaatcgatcggattgtaaggacattgattggacgacatatacctgtgtgctaggatttcaagtatttggtgtctgg

SEQ ID NO: 641 - DNA, 138 bp, Homo sapien
  misc_feature (1)...(138): n = A,T,C or G
ctgtgacaggaacattacctgaagtgcagggtggttacctgcacaaagtcccatttccaaaaatttctgtgtaattcaccagaaattttggatggaataattagaaaaaaaaaaagaggttaaaacntgtaactcaaa

SEQ ID NO: 642 - DNA, 381 bp, Homo sapien
  misc_feature (1)...(381): n = A,T,C or G
ctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcctaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtanaaattaaaa

SEQ ID NO: 643 - DNA, 403 bp, Homo sapien
ccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataattggcaagataatgagaaaagaaaaaagtcatggtaggtgaggtggttaaaaaaaattgtgaccaatgaactttagagagttcttgcattggaactggcacttattttctgaccatcgctgctgttgctctgtgagtcctagatttttgtagccaagcagagttgtagagggggataaaaagaaaagaaattggatgtatttacag

SEQ ID NO: 644 - DNA, 688 bp, Homo sapien
  misc_feature (1)...(688): n = A,T,C or G
cctatttatttgttttggccctggatctttcctaatcacaattatatttctttatttttgcctttgagcagtttcatttatctttgtgggcagggaagattaaatatgaaattcagtccagtcattttgctactggttagctttagtttgaggcaagtaaaaatttttgattaaaattagtttcttaaaattatgcccttgctttaccaaataatcaaattggctaaaaaataagggtatgtaactttgcattttgaagaacaaaccaataatttttcatgagccctactcgatcttctttaaagaagaccttcctaagagacaattagggatgagtttgattaatgggaaatagctctaggttagattattttaaattccatacaccaagtgatttaaccacagtggcagtggcagcttctgaaccgtcaagtatgaacatcacttaaaaattaaaagatgcttaataataaactcttaattttcattaagccaatctgtaattcagaagaaaagcatatgtctgccatgggactattgcagtgcgtctccatcagtgttaacacaggagagatatgttattttatgtgtatgtcttagtttgggatatgtggtagtaagaacatgtcaagagtgcttttcttcaaacctgncagctcaactgangaaagacaggtacttccattgc

SEQ ID NO: 645 - DNA, 484 bp, Homo sapien
  misc_feature (1)...(484): n = A,T,C or G
ccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggtactaaaaaagagaataacatgaaaacgcccagggttacttgaatgtttttataagataggaatatatgtcttcaccatgggggggggtctcggatttcactaacgttgtatatgaaaatgggtgcnataaaaagtacttttaaactttgt

SEQ ID NO: 646 - DNA, 447 bp, Homo sapien
  misc_feature (1)...(447): n = A,T,C or G
gggtcgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgnacaccattgtgtgtttgtaaaatgtgtatgtccc

SEQ ID NO: 647 - DNA, 388 bp, Homo sapien
gaaggtgatataaaatgactgtcatcatttggagtgtgcagtacagttacttcatgttcctcaggtttagaacaatttcccctgcaagttctcacacagataggcagaaatcataactaattttggttaatcactatggcagccgttgaagaatttaagagaacctgccagtaagatttggaataagattctatattattgcatccacagaaaagaatgtactgatatactataaactctaggagaaaacttaattgaaatagtgttattaagtgttgaaagtaccataaaaatataagggaaaataagctttcctagaatttttcagtgttctagtttttaaacagtgatgttttttattaacctatttcatccattcaaagacagg

SEQ ID NO: 648 - DNA, 632 bp, Homo sapien
  misc_feature (1)...(632): n = A,T,C or G
cctggctgggcntttgacctgcgnttttaaatnactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagatagatgtcaaagnatgattggtggagggagcaaggttgaagataatctggggttgaaattttctagttntcattccgtacatttttagttagacatcagatttgaaatattaatgttacctcctcaatggggtggtatcagacctgcccgggcggncgnntc

SEQ ID NO: 649 - DNA, 300 bp, Homo sapien
  misc_feature (1)...(300): n = A,T,C or G
nggtgaagatagaanaaatataagcgaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggctttggaagagttagaagaatttggaagg

SEQ ID NO: 650 - DNA, 498 bp, Homo sapien
  misc_feature (1)...(498): n = A,T,C or G
ngtnctgntaaacagaagggtacaangcccttctggctttaagcagtcataggaatgtgacagacattcctcttagggagcgcctcctcctagggtttcctcatctgtctcacactgagtggatgtaatgctattttaatcctgctgtggcccccaatactagtacttgtccataccttcttgcatttttagcgtctgctctgtggggttgttaggccctggcactcccaggaactagtgctaaagctgcatctntctctcccctctagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacag

SEQ ID NO: 651 - DNA, 654 bp, Homo sapien
  misc_feature (1)...(654): n = A,T,C or G
ctgagggtccccaggtttctaaagctctcaggacgagaaagtaggtcccaagataaggagcctaaagggcttttttctttctgtgtattccttcttggcctccaacatgggtacagtcacaagagcatgtaacagagaagaaggactanacctaccattttctggataaagaattggaaagaggatccacaggtaaccaaaaagtaccagggaaatggcagagaaggaaaacctcaggagaccaacctcataagtggtatttattagngcctgggctcaaatccaaattgtacatgaatatgtctggtcctagatagggtaccgaagactttgaaagtgaattttggtatatcattgcccagattccagactggntattgtgtgacacaacatacaggatatatctgaatagtgctcagaagagtttgaaaatgcaaatgatattaaaataaagatgaaaaagagaaagctggtcagaacttgtggacataacccttctggatctgtngcctgattaaaaaatagttgatattctcgaatgaattaaaacaagatttagagactgagcatggtagctnattcttgtaatccaacnctttgggagggcaaggcaanagaattgcttgcggccaggagttttgagaccagcttggg

SEQ ID NO: 652 - DNA, 293 bp, Homo sapien
  misc_feature (1)...(293): n = A,T,C or G
ngtctgttgcactgaggtgactaaggatacattttgaggaagtagctccaagaacatttccattttcactgtgccttcacatacatctaatggaaatgaacagcacccttcatccatccacggaagcgattaagaaaagggtgggatggaaaaattaacccaacaatattagatcaatacgtagtatttaagngtccataatgtgccaggctgaagatgcacgggaaaaccacactagccggtctgtcaagggcttgagaataccataaacaagaaaacagacgaaccaattt

SEQ ID NO: 653 - DNA, 294 bp, Homo sapien
  misc_feature (1)...(294): n = A,T,C or G
ngtccaccactgcagccctacatacagttgaaaaaaaattccattctgttaacatttgttttataagttttcacgcaatacacaaaaaacccctctgcacttcttgtaaagaacaaaaaagatacacaacagttaagcgtaaagatcacaggcaatagcattcaaacatggatgtgggtagagaaaggagtacctggcatgagtacctgcttagtttgactgaatccttgatttttaatttggcttttcatgggccgctcacaacaccaacgctgtgtgaggtatggtagtcag

SEQ ID NO: 654 - DNA, 250 bp, Homo sapien
ctgtccttgaacaagtatcaatgtgtttatgaaaggaagatctaaatcagacaggagttggtctacatagtagtaatccattgttggaatggaacccttgctatagtagtgacaaagtgaaaggaaatttaggaggcataggccatttcaggcagcataagtaatctcctgtcctttggcagaagctcctttagattgggatagattccaaataaagaatctagaaataggagaagatttaattatgagg

SEQ ID NO: 655 - DNA, 494 bp, Homo sapien
ccattataattttataacaccattaccctttaaattctaccgattataagcagcgtaaaagtaactatataaagcaaacatcgcaaaggaactctgcaggagctcttaattcctttatgtagctatcataaaattcactttcctgaagacatttactctcattcacttccaaactccaaacctttttctggtagcaccacttttgtttttaatagaaagatgagttcatatctgtacatctctccaaagctctaaggaatgagaaaaggatcctagtatattgaaattactgatgtttaatacctctgccttttcactaaaagccatttaatatttttaaagtcaaaacttgacatacaggtatttataaggaatctccatgactctgaaggaatgaaattgatgtaggtagctttggctatgtaaagacatagtagaggacaattacttaaagaagagttttcttttgaggatttgtagatttgactaagcag

SEQ ID NO: 656 - DNA, 477 bp, Homo sapien
cgcgttactgtacatattgctagcaggagacaactggaaatactaaacaaatactggaattcacattacagacagacgaaaccaacatggatgccacacataacttcctttgtagtttcacagagggcctatttgtggttgctcaggtggggtcatacattgcttgcagaaatggcctgatcatagctctatgaaacaatgaattcggaatgaaatcttaccatgacacctctctgtaggaaagaaatgttgcttcacgtgtgctaagttgagataataatatttcacatatttatatacagagaatcactctcaaatttaacccaagataagcaataggatttgggggtgacttgtacacatttctaacaacacttttcttttttctagaggtcactctcaaacactgatatatcactatagtttgagtgtagggattcagtaatcaaaggttgttattgcaaaagagccaggcag

SEQ ID NO: 657 - DNA, 576 bp, Homo sapien
  misc_feature (1)...(576): n = A,T,C or G
cctctacctgtanatcactatttttctaaagacaatttggtgttttgaagataaatgtcattagtctatgataatagcatcataggacaattagccattttagacttgaccatattttctctttttagcatatagccatcttgatatttaggtgggagactactccaatggagcaacagtttcattttacatgattggatttagaaatttacaaattttaaactcataagaattctaaataatttgaaaatggaaacatttgacccacagtctagcagcataaatacatttataaaatacttcattgttgatcttaggtcattgatttaaaacagaatttggtgactatgggcaggtggagggggccagtgaggaaggtataaaagagaaatctttatgaattgtgttcagattgattttgtataaacataatatattcatggttgtatctcttatttataatacccaactaacatgaaggtggtccaagggaaggatcaatattttaaataacatatttgcttaaaatatcatacagtggctgcttcataaaaaatcttataaacttttattacc

SEQ ID NO: 658 - DNA, 344 bp, Homo sapien
  misc_feature (1)...(344): n = A,T,C or G
cctgaaaagaaagntgctcttatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccag

SEQ ID NO: 659 - DNA, 230 bp, Homo sapien
ctgctttccctgctaaacagttccagagcaaaagcagcaaaaagaaaatatgggagggatatgggcaacgtatactcgaacgtacgcagagaagagagtacggttagctctaatatttctcattgaacttggtggtatgtgccttccctgcatataaggccatagtgcttttttgggagcgctagaatatccatccacttgacagtgaccacaaaataggctgtttccag

SEQ ID NO: 660 - DNA, 80 bp, Homo sapien
ctggtccttgttaaactcgatcaccactttggagagatcgactggaggctcctgggtgttctgaggggcctgggggacag

SEQ ID NO: 661 - DNA, 535 bp, Homo sapien
  misc_feature (1)...(535): n = A,T,C or G
ctgaaccatatctgattaactctttggtctctgttattggaacaaaaccgacgctatgcctgcagccgccagactgcaaccaaaaacacagtttggggtcagaagacattaaaaatcacaataaaataggatgaatgttctaagtcacgcaactgaatcaaggcacctttttttttcaaaagcaaaaagttgtttaacaatattccagaatagtagatacttcaaaaaccagattacagtatatatcattttgctgcacattttagtctattttctgtatacatagtcacacattctttaccctctcccaacttatacatgctttatccccccagtcatgtgctatgtaggtataaaaaaataaagttgtatctaaacaagtgatttaaaaaaaaaaactaacgaatgccncnatnataacnctgaacttgtttccctnttgaaggacattggaaatgttaccgaggttnntttacctnggccgcaaccncnctangggcnaattccagcncactgggggccgttactaggggat

SEQ ID NO: 662 - DNA, 257 bp, Homo sapien
cctgactaaagcacatatcacactccctacacttccatgttttctctcccatgtggaccctctgatgcatatcaagattcaagcgcctgttgtagcccttcccacagtcctcacatttgtatggcttttctacactgtgaactttttcttgcactttagagaatgaattctgtacaatgttcttcccatgctgctcacatttgagaggtgtttctctgctgtggcgtctctgatgggtcagacgagttgaggaccag

SEQ ID NO: 663 - DNA, 516 bp, Homo sapien
  misc_feature (1)...(516): n = A,T,C or G
ccaattataggtattttattttttaaagattagagngttcttgaagctctttctatttctttgtcaatgaactaaacattggcaaatatgtagggtttcccacataagaacattattaacatcaaaatagaaagctggtggtagaaataatgattgggaacacagagtctctactcagcgttctacttctgccataccataactttgtgatctcacgaaatatctctccatgttctcatccctatgtatagttctgtcatttttcaataagagctttttgcttaattatgaagtactagttactataaccattattttgagcttcatgtaaatcaagaacacatggactccacttgcaaaacattgaaaatgtagttagggattgggggcaaaaagcaacattttaaaatgtgtaaagacaatgagtaagcaacaaagtgtccaattttttaggcgaaagttgcatatgtcaggaaaaggcaggattaagtaatagagaatttgaatgataactgg

SEQ ID NO: 664 - DNA, 212 bp, Homo sapien
gtccgaggaggttagttgtggcaataaaaatgattaaggatactagtataagagatcaggttcgtcctttagtgttgtgtatggctatcatttgttttgaggttagtttgattagtcattgttgggtggtaattagtcggttgttgatgagatatttggaggtggggatcaatagagggggaaatagaatgatcagtactgcggcgggtagg

SEQ ID NO: 665 - DNA, 408 bp, Homo sapien
  misc_feature (1)...(408): n = A,T,C or G
atccaggggtncccggtngctgcngggaaacctccagccttgttcttcaaaccactcagctcatgtgttttgcgctgactagtactgaataatacaaccactcttatttaatgttagtattatttatttgacaactcagtgtctaacagcttgatatgcaggtccttgcatcctacatttctttaggaagttacccatttgtaactttaaaaacaggaaaaatatcagttggcaaatgcaatcttttttttttttaagctaaaggggggnnaacngnaannaaaatntttntgangtngggtctataagcacccttgangggatntgttaaaagngncatnaangggggattctcntttngcaaaaaaatntaannatcaatttatananctttatttttnactttnt

SEQ ID NO: 666 - DNA, 635 bp, Homo sapien
  misc_feature (1)...(635): n = A,T,C or G
ctgaagnacaagggtcaggcaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaaccttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttanctctcgaatgtcattggaatcttcacctcacagtggngttgaaactgctatagcctaagcnggctgtttactgntttncattagcaggtgctcaccatgtctttggggtgggnggggggagaaagaaagaan

SEQ ID NO: 667 - DNA, 388 bp, Homo sapien
gaaggtgatataaaatgactgtcatcatttggagtgtgcagtacagttacttcatgttcctcaggtttagaacaatttcccctgtaagttctcacacagataggcagaaatcataactaattttggttaatcactatggcagccgttgaagaatttaagagaacctgccagtaagatttggaataagattctatattattgcatccacagaaaagaatgtactgatatactataaactctaggagaaaacttaattgaaatagtgttattaagtgttgaaagtaccataaaaatataagggaaaataagctttcctagaatttttcagtgttctagtttttaaacagtgatgttttttattaacctatttcatccattcaaagacagg

SEQ ID NO: 668 - DNA, 498 bp, Homo sapien
  misc_feature (1)...(498): n = A,T,C or G
tgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttattcgtttaaaaagatttaaaaatcattgcactttggtcagaaaaataataaatatatcttatgaatgtttgattcccttccttgctatttttattcagtagatttttgtttggcatcatgttgaagcaccgaaagataaatgatttttaaaaggctatagagtccaaaggaatgttcttttacaccaattcttcctttaaaaatntctgaggaatttgttttcgccttacttttttttcttctgtcacaatgctaagnggtatccgaggttnttaatatgagattt

SEQ ID NO: 669 - DNA, 622 bp, Homo sapien
ccttagccaaagaatgcagtggagccttcccccttcaactgcattgtgaatgaataccaattaacagcataaaaattaatagtcccatatcagatctggaaggggtttctggggctgtctgatgtccctatcctgttgtagtgaacacaatagcagaaaattctttctgggtccatctgctataaagtcttggtaaaacagcattactatgaagaggatgaactcacctaccttcagatggaggaaaagtgaaaaggacttaggctttagtcctccatgacttttcttaagcactacctacctgtaataagctgagtgcaaaaggatgccgaagaaaatctgcacccagaagctgttagaaagcactgcagagaacagggtatgaagaaaataaagagttcttaataaacccttaagattctttgttcaaggtaaccttgccaaaagggcagagtaggtggcaaagagttgcttttaatctagctctacactgcatttgaaaataaaatttgcccattttgaatatattgtttataattaaatgtgctttttacactgcaggtcaatataaaaactggttagtaaatttccagcgagcatttatgttcatttgctcacagca

SEQ ID NO: 670 - DNA, 477 bp, Homo sapien
ttgggccctctagatgcatgctcgagcggccgccagtgtgatggatatctgcagaattcgcccttgccgcccgggcaggtgatggatgaggagcaaaaactttatacggatgatgaagatgatatctacaaggctaataacattgcctatgaagatgtggtcgggggagaagactggaacccagtagaggagaaaatagagagtcaaacccaggaagaggtgagagacagcaaagagaatatagaaaaaaatgaacaaatcaacgatgagatgaaacgctcagggcagcttggcatccaggaagaagatcttcggaaagagagtaaagaccaactctcagatgatgtctccaaagtaattgcctatttgaaaaggttagtaaatgctgcaggaagtgggaggttacagaatgggcaaaatggggaaagggccaccaggctttttgagaaacctcttgattctcagtctatttatcag

SEQ ID NO: 671 - DNA, 127 bp, Homo sapien
gtgtgtgtgtctacttgggcgtgtttaacgtgtgcgtttgtgtctgcgtgtgcatgtgtctgtgtgtgcgcgtgtatttcagtttgggttgccggatcccatatgattgcgtgcctgtgtacctgag

SEQ ID NO: 672 - DNA, 400 bp, Homo sapien
gggtctgcacagctatgttaacagcatccttataccaggagtaggaggaaagacacgactggaaaagcaattcaagctggtcacacagtgtaatgcaaaatatgtggaatgtttcagtgctcagaaagagtgtaacaaagaaaagaacagaaactcttcagttgtgccatctgagcgtgctcgagtgggtcttgcaccattgcctggaatgaaaggaacagattacattaatgcttcttatatcatgggctattataggagcaatgaatttattataactcagcatcctctgccacatactacgaaagatttctggcgaatgatttgggatcataacgcacagatcattgtcatgctgccagacaaccagagcttggcagaagatgagtttgtgtactgg

SEQ ID NO: 673 - DNA, 600 bp, Homo sapien
  misc_feature (1)...(600): n = A,T,C or G
ctggcgttgctcattagtgaatgtatgacagcaggatgtgaggggatgcccaggagtcagtgttagcattgtcatctgagatcactgctattaatatcatccattaatttattagtgagcttcactatatgcagactgggagataaggagaaaatctgtcacattctctctagctaatcagatcagctaccaattaatgagattctgaatgaaatatcaatatgtgtttttctaatttggacctaggacagagctgttgcttgtcatagagaaaaacaataatgcttaaacatagcacattataattaaagcaggtttctcacatacttttcattttatcctttggataattttgtgaggaacgcaggacaccaacttccctttcatagatacaatccccatgctattgatgaaagtgtttttgaatgaagccatacaacaaataactgatcaaagtggcattacaccaaaatttcttagtaggactcctgcatagaatgtttagatagacgtgaaaagtttgttcangaggaccagcaagagagaaactgggttctttgggagggtttcggtgctacatttataccctncatcagagtn

SEQ ID NO: 674 - DNA, 140 bp, Homo sapien
ggtggttggtgtaaatgagtgaggcaggagtccgaggaggttagttgtggcaataaaaatgattaaggatactagtataagagatcaggttcgtcctttagtgttgtgtatggctatcatttgttttgaggttagtttga

SEQ ID NO: 675 - DNA, 245 bp, Homo sapien
gttgggtggttggtgtaaatgagtgaggcaggagtccgaggaggttagttgtggcaataaaaatgattaaggatactagtataagagatcaggttcgtcctttagtgttgtgtatggctatcatttgttttgaggttagtttgattagtcattgttgggtggtaattagtcggttgttgatgagatatttggaggtggggatcaatagagggggaaatagaatgatcagtactgcggcgggtagg

SEQ ID NO: 676 - DNA, 621 bp, Homo sapien
  misc_feature (1)...(621): n = A,T,C or G
ctgtccccagggnaaatagtngaattcaactaagatctgttaataagatgtcagaataactaataattttattaggaaaaaatcatgttttaaatttcaaaatgacacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaattttaagtggttttcaataagtaatagtttttatcaaatttttggtgcttggtgcagagacggcgtggggaagggtgaatggttttgggaataattcagtgcacacctggggg

SEQ ID NO: 677 - DNA, 210 bp, Homo sapien
  misc_feature (1)...(210): n = A,T,C or G
tttacataanatattatcagcatttaccatctcacttctaggaatactagtatatcgctcacacctcatatcctccctactatgcctagaaggaataatactatcactgttcattatagctactctcataaccctcaacacccactccctcttagccaatattgtgcctattgccatactagtctttgccgcctgcgaagcagcggtagg

SEQ ID NO: 678 - DNA, 383 bp, Homo sapien
  misc_feature (1)...(383): n = A,T,C or G
gtaggagtcaggtagttagggttaacgagggtggtaaggatggggggaattagggaagtcagggttagggtggttatagtagtgtncatggttattaggaaaatgagtagatatttgannaactgattaatgtttgggnntgagtttntatatcacagccanaattntatgatgnaccatgtancgaacaatgctacagggatgaatattatggagaagtantctantttgaagcttagggagagctgggttgtttgggttgnggctcantgtcagttccanataataacttcttggtctaggcacatgaatattgttgtggggaanagactgataataaaggtggatgcgacaatggattttacataatgggggtatnagtt

SEQ ID NO: 679 - DNA, 371 bp, Homo sapien
aaaatgaaaatattgacaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaagg

SEQ ID NO: 680 - DNA, 176 bp, Homo sapien
cctaggattgtgggggcaatgaatgaagcgaacagattttcgttcattttggttctcagggtttgttataattttttatttttatgggctttggtgagggaggtaagtggtagtttgtgtttaatatttttagttgggtgatgaggaatagtgtaaggagtatgggggtaattatg

SEQ ID NO: 681 - DNA, 152 bp, Homo sapien
ctggagatggatatgagactagtcaagatgtgaatgctaattggagagaaatataattttaggaagatgcacattgatgtggggttttgatgtgtctgattttgactactcaagctctgtttacagaagaaaattgaatggcgagggtgtgg

SEQ ID NO: 682 - DNA, 141 bp, Homo sapien
ccagtgcttgcttgccgtggtttagtgattgggtgttagaaataaaaactcaggtctatttcttaccagtcagtaacaatttttagagaatgtacttggtatataatatatggacttcaggaactttgttggggtgggggg

SEQ ID NO: 683 - DNA, 308 bp, Homo sapien
ccagcaatggtacagagtgagggtgttctgctaatgacttcagagaagtatttaagaaaaacatagaaaaacgtgtgcggagtttgccagaaatagatggcttgagcaaagagacagtgttgagctcatggatagccaaatatgatgccatttacagaggtgaagaggacttgtgcaaacagccaaatagaatggccctaagtgcagtgtctgaacttattctgagcaaggaacaactctatgaaatgtttcagcagattctgggtatcaaaaaactagaacaccagctcctttataatgcatgtcag

SEQ ID NO: 684 - DNA, 277 bp, Homo sapien
tggtattaggattaggatgtgtgaagtatagtacggatgagaaggttggggaacagctaaataggttgttgttgatttggttaaaaaatagtagggggatgatgctaataattaggctgtgggtggttgtgttgattcaaattatgtgttttttggagagtcatgtcagtggtagtaatataattgttgggacgattagttttagcattggagtaggtttaggttatgtacgtagtctaggccatatgtgttggagattgagactagtagggctagg

SEQ ID NO: 685 - DNA, 457 bp, Homo sapien
  misc_feature (1)...(457): n = A,T,C or G
ctgtggcgtnccctacttctcccaaacctcgcaactccctcccaggacagtcagtgccaaagaaacaggtcgctgaaaactaaaatgtccacatccctaactggcaacccacatcaaccccaaaaggttgaagaatcatctaagatatttcagatgctctatgaagaaattcactttaacacttataactgtaagactttgcatacattacaacagtgcattagtgatacaagttgtaaaatacgtttccattcctttggattttgcatatgatggttttgcatcagtcactgcaggtagattgagcaagctttttgtgtttgtttttttaaacatgcattcaactagatatgattcagaatagattaatactccctttttatcactacagttagctaaaaaattgccaggcagtccacaaaacagaatttgctttaagaccaacccacagagtcag

SEQ ID NO: 686 - DNA, 234 bp, Homo sapien
  misc_feature (1)...(234): n = A,T,C or G
ntggatttataaaatagttgcaatgacaaaagaagtatgttttgacagtaaaaaaaagacattatggacaaaatatgcaaaatgtgcaaagaaaaaataaatttgcattagaaaggtgggcatttgatctctgagccctgtgccatgtaacattgccatgttctttcactgttgtttgaatgttgtaccccagcccttgactctggacttaaggcaagctatgactggctttgg

SEQ ID NO: 687 - DNA, 315 bp, Homo sapien
  misc_feature (1)...(315): n = A,T,C or G
nngtctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgngtgtcatatcctattttgtgatgatggggattctgaccatttatacctcatataaggagaagagcatctttctcgtggcccacaggaaagatcctacaggaatggatcctgatgatatttggcag

SEQ ID NO: 688 - DNA, 522 bp, Homo sapien
  misc_feature (1)...(522): n = A,T,C or G
ctgaattagaggaggagaaaagaagccattnnggagtactttaattgtttagatgtgagaggctgaatgtttgggttaagatgttagttgtcagaatcatgagaaaaggttttaagcaaggggcatttctaattctaaaaataacaactactgttatttattgagcactatctttttgttgggtactgtctaaagtacttgatttattttttaaaaccttacaaaaaacttacaaggtaggtactgaaagattcagtaatttgttcaaagtcacacagcaaataagcaacagactctggatttgaaccaggcaatcctagagcctgtactgttagtaattatactttagcacctgtcaagaattcctgttgagtgtcaagaagcaancaccaagttaggatttaaagcaaacatgattgaagaatactgtggtgtggttgacagtagtgcctaagtctgttttcagagtgaaaaatgacaaattagattttaagtatggtttggagataatatcaggacagt

SEQ ID NO: 689 - DNA, 158 bp, Homo sapien
  misc_feature (1)...(158): n = A,T,C or G
tctcaacttantntnatacccacacccacccaanaacagggtttgttaggnattgtttgcattaataaattaaagctccatagggtcttctcgtcttgctgtgtcatgcccgcctcttcacgggcaggtcaatttcactggttaaaagtaagagacag

SEQ ID NO: 690 - DNA, 300 bp, Homo sapien
  misc_feature (1)...(300): n = A,T,C or G
tagaactcgtatttttaaacttctattctctanccttttccactacattatgacacaagaccctgcagaaagtcgtctggaaaatatcagaccatctcttacttgtcccatccaatcttacatcgaattatatgcacccttaaaaagttatttggagttttaaaaaactctattagcccaaattacctgaaataaactcctggcttgttcccctaatgtttataaaaaattgattgaaaatattcattttaaaaatgaagntcttgaatttatttaaattactgtcttgcagtgagttgg

SEQ ID NO: 691 - DNA, 305 bp, Homo sapien
ctgttcagaaagctcattggacctggttttgaaaataaaacaaagttaaaaccctgggaggagttattgtgcagtgtggagtactcaggctttcttataaagaaaaaaaaagttatctggtaccaaagtgtgcaacctacagaccctcaggtactgccctgtgacttctctgtatgacatcacaaggctgccaagtgcctgtttttctagaactaggagttggtgaggtttggctagtgctgaaaccatgcataggattggtttactaaattaaaaccttattacgtacgtcctccaaaagacag

SEQ ID NO: 692 - DNA, 582 bp, Homo sapien
caggaaatggataaccattttaactgtattttttgcagcccgtaccttcttgggaatacaattgtctaactttttatttttggtctggctgttgtggtgtgcaaaactccgtacattgctattttgccacactgcaacaccttacagatgtggaagatgtgaaatttgtcatcaattatgactaccctaactcctcagaggattatattcatcgaattggaagaactgctcgcagtaccaaaacaggcacagcatacactttctttacacctaataacataaagcaggtgagcgaccttatctctgtgcttcgtgaagctaatcaagcaattaatcccaagttgcttcagttggtcgaagacagaggtgcaggtaaggatgactgataggaaatgttggtagttacgagtcacatcgttgtctacaaatccatttaaatggtattggagggtgagtaaaaccttgaatgtgaaaacttaagctgaaaaattgtaaaaacatttcacgcctaccatgaatagatctgtttctttctgtccacaatgatttgtgtcatagacataattgatcaatttgcaattg

SEQ ID NO: 693 - DNA, 275 bp, Homo sapien
ccaattgatttgatggtaagggagggatcgttgacctcgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactatgagggcgtgatcatgaaaggtgataagctcttctatgataggggaagtagcgtcttg

SEQ ID NO: 694 - DNA, 397 bp, Homo sapien
  misc_feature (1)...(397): n = A,T,C or G
nggtctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccag

SEQ ID NO: 695 - DNA, 609 bp, Homo sapien
  misc_feature (1)...(609): n = A,T,C or G
ctgagcttccatttgtcagctagcactgnggtagtcaaccatgcgaatgaggctattttggacctcatgattgtccagtgcctgggctgataccgngggaaacgaaattttgtggctgcccacaaaatcatggaaaataatgattttttagaaaacctccactgntttgttgtgcagcaataaataactgaaacaccaatccaaaaaacttataaagctataacaattaaaacagnataataatagtnccgggatacaaaaatggtcaaattgaagaggatacaaagcctcaaagcagtcctcactcataananccttgttgtatcactaaaanggcattaaaattgagaanaaggaanaactagtggattaattaataaatgagaagtatccataaggaaaaattaaaattnnattcttgcttcacattatgaaaaaatacaaacaacagattgattaaagacttaaatgngatcaacaaaatgttaaaactgtgataagaacatttaagaaaatagttctatnaccctgggataaaacattttcntccaaggcattaaagtgttaaatgaaaagactgatncatttattcattagaatttaaattcn

SEQ ID NO: 696 - DNA, 300 bp, Homo sapien
ctgcaaaataagcgtgctaaattaaattgtcttaaggtttttccacttcattttgtgactttgtgtggttcgaatttctcagtattttaaccagtgtgttgatgttaaagtcaaaggctgcagtatgtctatattcttgctgtactcattggtagtttcagtatatgtaatgtgagtttaaatagtgaaattgtatctcatattaacatttcaaatgctcatattgaaaatggaaaatagtaaacacgggaattgattttattctggttgtctataatacttcattttaaatgtaaatgg

SEQ ID NO: 697 - DNA, 391 bp, Homo sapien
  misc_feature (1)...(391): n = A,T,C or G
nngtcatgtntgatgnatctgancaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagnaaggcatggttgtggttaatctggtttatttttgntccacaagttaaataaatcataaaacttgaacaaaaaaaaa

SEQ ID NO: 698 - DNA, 536 bp, Homo sapien
  misc_feature (1)...(536): n = A,T,C or G
ctgagcatacagcaataaaaataacataatttttatgtgtacaatatttatggaatacgttactggaacagataaataatttagttaataacatgacaaagaacagaaattgtatacactatacagcatagtaatagaataatgaatgattaaagttattaatattaggtagaaaatgaagggtatctttgagagcagaactcaaggaagcaagcaatttgccttatgaggaaagagttacctgtggataaaggagaaactgaaaaatttacaagtcaagactttttgagcaaagacaaaaatatgactatgagtcaccaattcagtacagtgaaaaaaaagttgaagagatatcttggaagtaaaccatgttgtggaagagcagggttttgataatcatgggattattctgaatgaattttaaatgcgataggaatatatgagataatttcaccagagaataatatgatcatgtttgcatttcaaaggggtgtatctggtgcactgngtagaataaataggntatgtgagcaagt

SEQ ID NO: 699 - DNA, 419 bp, Homo sapien
  misc_feature (1)...(419): n = A,T,C or G
ngtccacctgagggcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccag

SEQ ID NO: 700 - DNA, 336 bp, Homo sapien
ccacttattgtccttaaaaatccatactgatacatggacagtaagtgtgttttcagatggagtaccagcaccgaaaatgggttgagggaggatgggttgtatgtatgtttctgcccactaattttgagcagccatattatgaattaaatcgtcacagccaagtaataacccaagaatggtatgagtttcatgtgtaatagctcaaatggaataagcatgaatgctggagtggaccattatcctcaaatattctatgtcacttctcatttaaagactcttgttatgaactattagaaactttaggcaaaatcaaaagtatttgcggcaaaataaagg

SEQ ID NO: 701 - DNA, 418 bp, Homo sapien
ccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaagg

SEQ ID NO: 702 - DNA, 261 bp, Homo sapien
  misc_feature (1)...(261): n = A,T,C or G
gggcctgttgtgggggtgggggaagcagggaggggaacagctaaataggttgctgttgatttggttaaaaaatagtagggggatgatgctaataattaggctgngggtggttgtgttgattcaaattatgtgttttttggagagtcatgtcagtggtagaaatataattgttgggacnattagntttagcattggagtaggtttaggttatgtacgtagtctaggccatatgtgttgganattgagactagtagggctagg

SEQ ID NO: 703 - DNA, 261 bp, Homo sapien
  misc_feature (1)...(261): n = A,T,C or G
gggcctgttgtgggggtgggggaagcagggaggggaacanctaaataggttgctgttgatttggttaaaaaatagtagggggatgatgctaataattaggctgngggtggttgtgttgattcaaattatgtgttttttggagagtcatgtcagtggtagtaatataattgttgggacnattagntttagcattggagtaggtttaggttatgtacgtagnctaggccatatgtgttggagattganactagtagggctagg

SEQ ID NO: 704 - DNA, 381 bp, Homo sapien
  misc_feature (1)...(381): n = A,T,C or G
ngtntgaattctattaaagatacaaagaggagctggtaccatttcttctgaaactattacaaacaactgaaaaggtggaatttctccctaattcattttaggaggccagcattatactgataccaaaacctggcagaggtacaataataaaaggaaacttcaagtcagtatcactgatgaacaccaatgtgaaaatcctcaataaaatactggcaaactgaattcagcagcacatcaaaaagctaatccaccacaatcaagtcagcttcatccctgcgatgcaagtctggttcaacatatgcaaatcaataaatacaattcatcagataaacagagctaaagacaaaattcacatgattttctcaatagatgcagaaaagg

SEQ ID NO: 705 - DNA, 477 bp, Homo sapien
ctgaaccctcgtggagccattcatacaggtccctaattaaggaacaagtgattatgctacctttgcacggttagggtaccgcggccgttaaacatgtgtcactgggcaggcggtgcctctaatactggtgatgctagaggtgatgtttttggtaaacaggcggggtaagatttgccgagttccttttactttttttaacctttccttatgagcatgcctgtgttgggttgacagtgagggtaataatgacttgttggtgattgtagatattgggctgttaattgtcagttcagtgttttaatctgacgcaggcttatgcggaggagaatgttttcatgttacttatactaacattagttcttctatagggtgatagattggtccaattgggtgtgaggagttcagttatatgtttgggattttttaggtagtgggtgttgagcttgaacgctttcttaattggtggctgcttttagg

SEQ ID NO: 706 - DNA, 266 bp, Homo sapien
  misc_feature (1)...(266): n = A,T,C or G
ccatggctaggtttatagatagttgggtggttggtgtaaatgagtgaggcaggagtccgaggaggttagttgtggcaataaaaatgattaaggatactantataagagatcaggntcgtcctttagtgttgtgtatggctatcatttgttttgaggntagtttgattagtcattgttgggtggtaattagtcggttgttgatgagatatttggaggtggggatcaatagagggggaaatagaatgatcagtactgcggcgggtagg

SEQ ID NO: 707 - DNA, 358 bp, Homo sapien
  misc_feature (1)...(358): n = A,T,C or G
ccatcagagaaatgcaaatcaaaaccacaatgagataccatctcacaccagttagaatggcaatcattaaaaagtcaggaaacaacaggtgctggagaggatgtggagaaataggaacacttttacaccgntggtgggactgtaaactagttcaaccattgtggaagtcagtgtggcgattcctcaaggatctagaactagaaataccatttgacccagccggccaatattcaacattcttaaaggaaagaattttcaacccagaatttcatatccagccaaactaagcttcgttagtgaaggagaaataaaatactttacagacaagcaaatactgagagattttgtcaccaccagg

SEQ ID NO: 708 - DNA, 491 bp, Homo sapien
  misc_feature (1)...(491): n = A,T,C or G
cctactatgggngttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccaggtttcaatttctatcgcctatactttatttgggtaaatggtttggctaaggttgtctggtagtaagggnggagtgggtttg

SEQ ID NO: 709 - DNA, 460 bp, Homo sapien
  misc_feature (1)...(460): n = A,T,C or G
nggttttttttgtagagcaaataatttatgcaaaatatgttacaaaatctgggatgctaaatagttgacacaagtactgtgtttgacatttagtttcatttgaattagtaatagaatttgctccttccaacatttacatcttttttctttctgactttatatattttcaataaaaatttgctccacagtttttaagntcattcttcttgaatccgnttttacatttgctgngacaaacctgcataaaactagattttatagatataacttctttggaagagataaaaattcaaaagtttgacattgctttcanttattcttttcttcattgttttgattggcccctgttagattgatgtattgccaatctacttttgatggcatgaatntaaaatgacaacataaaaagcncttctagtgcaacagtaattgaaacttgcagttttccattaaaaaaaaa

SEQ ID NO: 710 - DNA, 542 bp, Homo sapien
  misc_feature (1)...(542): n = A,T,C or G
ctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcatagatcctactatgcgattaacactgtttatgtatatggacaagagaaatacttgttgttgcatgatatctcagaatcggaatttctaactgaagctgaaatcatttgngatgttgtatgcctggtatataatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtnaggatatctttgttaaattgacaacaatggacctg

SEQ ID NO: 711 - DNA, 394 bp, Homo sapien
  misc_feature (1)...(394): n = A,T,C or G
caaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactanaaataactttgcaaggagagccaaagctaagacccccgaaaccagacgagctacctaagaacagctaaaagagcacacccgtctatgtagcaaaatagtgggaagatttataggnagaggcgacaaacctaccgagcctggtgatagctggttgtccaagatagaatcttagttcaactttaaatttgcccacagaaccctctaaatccc

SEQ ID NO: 712 - DNA, 552 bp, Homo sapien
  misc_feature (1)...(552): n = A,T,C or G
gaggtctgtanaatgccaggctcaaatttgtctttataatttaataccagaaatctttcccttgtgatgtttctttctttctggattgcctctatagcaggggatagcgggggaggataaggcacatctttgntgtactgagaaatttgaccacgcaggatgatgtggctgttctcattcatctgcacagagaaaaataatgataaaatatccctttcctatgtttactgattttatggctgccataatggaagcctccttgactatttaatcctttctgtcaactaggttcgattttttttttaatttacctgttagaggtatttaanaattttaactagctanaaataattacattccaaaggaacaccaaggcaaataaatggttggtaatcagcaaaagaattacattagttgttgntgctacttattagggggagaactgtttttttttaaatttaaacaatttaataatctcaactgcaaataattttagatgcagcaaaggactatgtagncgttaatacctcatgttgatattttcataatatt

SEQ ID NO: 713 - DNA, 518 bp, Homo sapien
  misc_feature (1)...(518): n = A,T,C or G
ccaaaaactggaagcagctcactaaacaaacagtggcatacccatagaactgcatacttctcagcagtatgaaagaatgagctacttatataagcatcattgataaacctcaaaaaaaaaatgccacatgaanaaacccaaagggganaaacataaaaactttatatgtcagtcatataaaattctanaaaatgcaaactaatccatcntaaaggaaagtaaatcaacagttgtctggaggaccananagagcaggaggaganagattattaaaggggttaaagtaaatttgggagtgcccttccntttttaaatnctatgaaaatgaaagtaaaggcncatgcatgttgtaaactaatagtaacaaacanaatgggttggagtggggtgttgtctggggacatcattacaaaatgtaagccagtttatntaaattttgaaaagaccgtggactctgatctgactgatnaatgttggaagagataagtgtgctgcaaatgggggaattaataaaacag

SEQ ID NO: 714 - DNA, 281 bp, Homo sapien
ccaattgatttgatggtaagggagggatcgttgacctcgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactatgagggcgtgatcatgaaaggtgataagctcttctatgataggggaagtagcgtcttgtagacc

SEQ ID NO: 715 - DNA, 443 bp, Homo sapien
cttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcccgacatggagtctgatatacgttcatgggaattgtttctttctaatgttacaaaagaaattgagaaagcaaagtctcagtttgaagaacaaattaaggcaattaaaaatggttcccggctcagtgaactttctaaagtgcagatttctgagctttcatttcctgcctgtaacacggttcatcccgagttactccctgagtcttcaggccacgatgg

SEQ ID NO: 716 - DNA, 639 bp, Homo sapien
  misc_feature (1)...(639): n = A,T,C or G
ccaaanaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacnaaatggaagaatttangattctaaatgaccaaaacanagcattaaaatcagaagttcagaagctgcagactcttgtttctgcacangcctaataaggatgntgnggaacaaatggaaaaattg

SEQ ID NO: 717 - DNA, 473 bp, Homo sapien
  misc_feature (1)...(473): n = A,T,C or G
nntgaggctactgctgttttattacaacattacctcttgtttttataaagtgtaccaagatttaaattgataactttattttacttgaaaaaaaaaagtttnttttatcaccagtgttacagttgtcttctgtttctttttgttttgntttatttgntttcctttttagccaaagagtgaacagaanattttcttattttggtggctattcattttacttttaaaagtgattggtggattttagactaattatgggggaatttgccaccaaaataaaaaatatgtaaagngtagtgattacagagtggttaaaatgtgggttagtacttatttattccattaattgattatttgactgtttataaagaaagttgctttatttctttaaacatcttcaaaagatgatcctttcttgtcacattatagccaaaagaagcagagaacttcactgtctgcatttggttcctggttgg

SEQ ID NO: 718 - DNA, 207 bp, Homo sapien
ggtaaatgctagtataatatttaccatctcacttctaggaatactagtatatcgctcacacctcatatcctccctactatgcctagaaggaataatactatcactgttcattatagctactctcataaccctcaacacccactccctcttagccaatattgtgcctattgccatactagtctttgccgcctgcgaagcagcggtagg

SEQ ID NO: 719 - DNA, 255 bp, Homo sapien
  misc_feature (1)...(255): n = A,T,C or G
cctatattacggatcatttctctactcagaaacctgaaacatcggcattatcctcctgcttgcaactatagcaacagccttcataggctatgtcctcccgtgaggccaaatatcattctgaggggccacagtaattacaaacttactatccgccatcccatacattgggacagacctagttcaatgaatctgaggaggctactcagtagacagncccaccctcacacgattctttacctttcacttcatcttgcc

SEQ ID NO: 720 - DNA, 455 bp, Homo sapien
  misc_feature (1)...(455): n = A,T,C or G
ccaatgtcgaaacctacaagatttccttaaaatctctaatagaggcattacttgctttcaattgacaaatgatgccctctgactagtagatttctatgatccttttttgtcattttatgaatatcattgattttataattggtgctatttgaanaaaaaaatgtacatttattcatagatagataagtatcaggtctgaccccagtggaaaacaaagccaaacaaaactgaaccacaaaaaaaaaggctggtgttcaccaaaaccaaacttgttcatttagataatttgaaaaagctccatagaaaaggcgtgcagtactaagggaacaatccatgtgattaatgnttncattatgttcatgtaanaagccccttatttttagccataattttgcatactgaaaatccaataatcagaaaagtaattttgccacattatttatnaaaaatgttcc

SEQ ID NO: 721 - DNA, 530 bp, Homo sapien
  misc_feature (1)...(530): n = A,T,C or G
ccagtgcttgctgccgtggtttagtgattgggtgttagaaataaaaactcaggtctatttcttaccagtcagtaacaatttttagagaatgtacttggtatataatatatggacttcaggaactttattggggnggggggttaattttgccttaccctgttcactttcagatgattaggcttttgcactttagaatgagaaacttgtgacgttagtgtgttcttactagctttaatttgtatgtagcaatgaattgtgaatcttagtgcagtgggtttttttaaaaaactcaaaaagctgggaattaagtggtttcagtaataatgctataccgaggtgcttgcattgtatttcataattttgttacaaaccaaaattatttttaatganaacggtcttgggttcagaggtgtgatgccagaatgtattttcgtactgttaggcccttggaacagataccggtgctttcttgaaagatgaaagaaatgcaatgggtgctcttcatgcaaggttgcaaacctaccaagaat

SEQ ID NO: 722 - DNA, 242 bp, Homo sapien
  misc_feature (1)...(242): n = A,T,C or G
ccaagggtcatgatggcaggagtaatcanaggtgntcttgtgttgtgataagggnggagaggttaaaggagccacttattagtaatgttgatagtagaatgatggctagggtgacttcatatgagattgtttgggctactgctcgcagtgcgccgatcagggcgtagtttgagtttgatgctcatcctgatnagaggattgagtaaacggctaggctagaggtggctagaataaataggagg

SEQ ID NO: 723 - DNA, 472 bp, Homo sapien
  misc_feature (1)...(472): n = A,T,C or G
cctactatgggtgttaaattttttactctctctacaaggttttttcctagtgtccaaagagccgttcctctttggactaacagttaaatttacaaggggatttagagggttctgtgggcaaatttaaagttgaactaagattctatcttggacaaccagctatcaccaggctcggtaggtttgtcgcctcnacctataaatcttcccactattttgctacatagacgggtgtgctcttttagctgttcttaggtagctcgtctggnttcgggggtcttagctttggctctccttgcaaagttatttctagttaattcattatgcagaaggtataggggttagtccttgctatattatgcttggttataatttttcatctttcccttgcggtactatatctattgcgccaggtttcaatttctatcgcctatactttatttgggtaaatggtttggctaangttgtctggtag

SEQ ID NO: 724 - DNA, 292 bp, Homo sapien
  misc_feature (1)...(292): n = A,T,C or G
nccaccactgcagccctacatacagntgaaaaaaaattccattctgttaacatttgttttataagttttcacncaatacacaaaaaacccctctgcacttcttgtaaagaacaaaaaagatacacaacagttaagcgtaaagatcacaggcaatagcattcaaacatggatgtgggnagagaaaggagtacctggcatgagtacctgcttagttngactgaatccttgatttttaatttggcttttcatgggccgntcacaacaccaacgctgngngaggtatggtagtcag

SEQ ID NO: 725 - DNA, 122 bp, Homo sapien
  misc_feature (1)...(122): n = A,T,C or G
atagaaagggcatacccaaaatgttactgaaaatntaatacaaattccaagattcaccaangaagtaacaaaaacctggcctgcangnggncccctatcccgtggctccatggntgatgtgg

SEQ ID NO: 726 - DNA, 477 bp, Homo sapien
  misc_feature (1)...(477): n = A,T,C or G
ctgaaccctcgtggagccattcatacaggtccctaattaaggaacaagtgattatgctacctttgcacggttagggtaccgcggccgttaaacatgtgtcactgggcaggcggtgcctctaatactggtgatgctagaggtgatgtttttggtaaacaggcggggtaagatttgccgagttccttttactttttttaacctttccttatgagcatgcctgtgttgggttgacagtgagggtaataatgacttgttggtgattgtanatattgggctgttaattgtcagttcagtgttttaatctgacgcaggcttatgcggaggagaatgttttcatgttacttatactaacattagttcttctatagggtgatagattggtccaattgggtgtgaggagttcagttatatgtttgggattttttaggtagtgggtgttgagcttgaacgctttcttaattggcggctgcttttagg

SEQ ID NO: 727 - DNA, 416 bp, Homo sapien
cctgtctttgaatggatgaaataggttaataaaaaacatcactgtttaaaaactagaacactgaaaaattctaggaaagcttattttcccttatatttttatggtactttcaacacttaataacactatttcaattaagttttctcctagagtttatagtatatcagtacattcttttctgtggatgcaataatatagaatcttattccaaatcttactggcaggttctcttaaattcttcaacggctgccatagtgattaaccaaaattagttatgatttctgcctatctgtgtgagaacttacaggggaaattgttctaaacctgaggaacatgaagtaactgtactgcacactccaaatgatgacagtcattttatatcaccttcaattacccaacagcttttaatagtctgg

SEQ ID NO: 728 - DNA, 416 bp, Homo sapien
  misc_feature (1)...(416): n = A,T,C or G
cctgtctttgaatggatgaaataggttaataaaaaacatcactgtttaaaaactagaacactgaaaaattctaggaaagcttattttcccttatatttttatggtactttcaacacttaataacactatttcaattaagttttctcctagagtttatagtatatcagtacattcttttctgtggatgcaataatatagaatcttattccaaatcttactggcaggttctcttaaattcttcaacggctgccatagtgattaaccaaaattagttatgatttctgcctatctgtgtgagaacttacaggggaaattgttctaaacctgaggaacatgaagtaactgtactgcacactccaaatgatgacagtcattttatatcaccttcaattacccaacagcttttaatantctgg

SEQ ID NO: 729 - DNA, 564 bp, Homo sapien
  misc_feature (1)...(564): n = A,T,C or G
ctgtgagtagaggagtcttcccgagagtagcagttgttgatccaaatgattgaagccttcaggtaagggaataactgctgcaggaattctttcttgaagaatttaagctgtttggtaagaattctgtaactacatacctttgaaacactattcacattcaaataaacgcttgttttctagccaggcacaggctcaattagtttttcaaactctagccaaggcagtatttcatttgggaaatcatgcaacagaactgctcaattcttaacttctcctgctgttaacatttacacttagactgccagcaacagttaacttaaattttggtctcaagggaacaaaaaaaaattgcattcagaatttaatatagtattttaaaactaattttagcctgtaagncattatgagcaatagtaacttttatacctcctcatcttgnctgataatatattctatatgctgncaatctgattatatagtctatatgctagaagttgctgattttcattctgccaccaaaaaaaactgtccttttttttttatgggggaaaaagggaatttaaa

SEQ ID NO: 730 - DNA, 310 bp, Homo sapien
ccatttttatttcttcttcagagaagtgtttatttaggtctgttgcccattttacaattaggccatatgttttcttgctgttgagttgtatgtgtgtttgtataaattttgcatattaaccccttatcacacgtatgttttttaaaataaattttgcttattaatcttttatcagatgtatggtttccaaatatattcttccgatccatggattctcttttttgttatgattgtttctttgctcttcggaagctttttgttttgttttgttatttgttttactttgatatagtcccatttattgtttttg

SEQ ID NO: 731 - DNA, 467 bp, Homo sapien
  misc_feature (1)...(467): n = A,T,C or G
ngacaaccttagccaaaccatttacccaaataaagtataggcgatagaaattgaaacctggcgcaatagatatagtaccgcaagggaaagatgaaaaattataaccaagcataataaagcaaggactaacccctataccttctgcataatgaattaactagaaataactttgcaaggagagccaaagctaagacccccgaaaccagacgagctacctaagaacagctaaaagagcacacccgtctatgtagcaaaatagngggaagatttataggnagaggcgacaaacctaccgagcctggtgatagctggttgtccaagatagaatcttagntcaactttaaatttgcccacagaaccctctaaatccccttgtaaatttaactgntagnccaaagaggaacagntctttggacactaggaaaaaaccttgtagagagagtaaaaaatttaacacccatagtagg

SEQ ID NO: 732 - DNA, 492 bp, Homo sapien
  misc_feature (1)...(492): n = A,T,C or G
cctactatgggtgttaaattttttactctctctacaaggttttttcctagtgtccaaagagctgttcctctttggactaacagctaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggnttcgggggtcttagctttggctctccttgcaaagttatttctagttaattcattatgcagaaggtataggggttagnccttgctatattatgcttggntataatttttcatctttcccttgcggtactatatctattgcgccaggtttcaatttctatcgcctatactttatttgggtaaatggtttggctaaggttgtctggtagtgaggcggagngggtttggg

SEQ ID NO: 733 - DNA, 562 bp, Homo sapien
  misc_feature (1)...(562): n = A,T,C or G
ntgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccanatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgnttcctcctttagggaggcaatgcaaagagngtggacatcttctaatcttgaggaacagtngttgatttcccttgaaggagcttacatattgactgtntttcacaataacctgnttgccccagntcaatccctcattttaatacttaatgttggtnctgggct

SEQ ID NO: 734 - DNA, 265 bp, Homo sapien
  misc_feature (1)...(265): n = A,T,C or G
nggtccagaacaagagaaataactgcagaaaacacatatggttggaaaccatgcgcttgtgactttttctgtagcctatgggagtggacagagtgggtaacccaagatgtttttaagactgactggactaagaatggcgtacttatagccaactacttcccccctaatgtgactgaagggattcataatgatcacaattagcattacggttaagtattttagggttgacgtctaagctcacacttgaaaggtatttatctaatgg

SEQ ID NO: 735 - DNA, 216 bp, Homo sapien
atttaatacgtgctcactgctcggcacgcgctgaagctacagttaacaatcagtgagcacatattaaatgataaaataatgctgatggtaaacattcataacagcagagtaagattttggcagttttgtgtctcggtaacataactgtaaccttagatgaacacctatcccttcatgatctgactttagaggcaaggagtttgtaacatctaatgg

SEQ ID NO: 736 - DNA, 285 bp, Homo sapien
  misc_feature (1)...(285): n = A,T,C or G
ctgaaaggcaacntggagactagttagtctagtcccctcatattataaattggtatgctgaggccaggcagtaaattgctatggagctctccaatttaaggccagtttgactccaagggtagggcttctagtaaaattttgtgattaaattggaaactctaatttatttttctatgngtttttggtacctaatcctcataagcaagccatatttcaaggctgatcaatgaaaacaccaaataccaaagcttcctttcccttccaaatttactgaccctttgtcag

SEQ ID NO: 737 - DNA, 509 bp, Homo sapien
  misc_feature (1)...(509): n = A,T,C or G
agangaagaagangaagattaagggaaaagtacatcggtcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgngaggagctaatccctgaatatctgaacttcattagaggggtggnagactcggaggatctccctctaaacatatcccgtgagatgttgcaacaaagcaaaattttgaaagttatcangaagaatttgggtcaaaaaatgcttanaactctttactgaactggcggaagatnaagagaactncaaganattctatgagcagntctctt

SEQ ID NO: 738 - DNA, 97 bp, Homo sapien
cagtgaattgaatacgactcctatagggcgaattgggccctctagatgcatgctcgagcggccgccagtgtgatggatatctgcagaattcgccctt

SEQ ID NO: 739 - DNA, 209 bp, Homo sapien
  misc_feature (1)...(209): n = A,T,C or G
ccgncagtgtgatggatatctgcagaattcgcccttagcggcccgcccgggcagggtccttatatatagtagcttagtttgaaaaaatgtgaaggactttcgtaacggaagtaattcaagatcaagagtaattaccaacttaatgtttttgcattggactttgagttaagattattttttaaatcctgaggactagcattaattgacgg

SEQ ID NO: 740 - DNA, 164 bp, Homo sapien
ccaagctaatgggtgacactgtgaatgcaactctaatgcagcctggcgtaaatggtcctatgggcactaactttcaagttaacacaaacagaggaggtggtgtgtgggaatctggtgcagcaaactcccagagtacatcatggggaagtggaaatggcgcaaat

SEQ ID NO: 741 - DNA, 514 bp, Homo sapien
  misc_feature (1)...(514): n = A,T,C or G
ccagtcagaattgagatgtgctgtgagtgcaaaatacactcaaatctaagacttagtatggaagaaaaagaagataaggtgnttcattaataatcttttatattgattacatgttgaaatgatatttttaatatactgggttacataaactgttattaagattaattttgcttgtttcttttttaatatggctactagaaaattaaaaattatgttgtggttcacattatatttctgttgaacaatgtggacatagataatctacagtcattacattagccttagaatttagcatcatacttttaagcactctggggtactaacttgaactcccagaaacccataagcacactctgcatataaattattgcaaaattcattcttatctctctgaaagatatgcattttaagggtaaaaagaattcacaaaatattgantccttaacaaatgtcaattagtatatggagagagctaaaggacttcntgtagactggtncattggggaaaaacaga

SEQ ID NO: 742 - DNA, 439 bp, Homo sapien
  misc_feature (1)...(439): n = A,T,C or G
gcaggtcctatgcatagttaataagggntataatctactcaacatggaaaatgggagcctatttgcaaacacacgagtaattaaagtaccaattctctcttagtttctttttttatagttggnttattttgcaattataaatgntaaacatccctagagatgaaagttaaaatggctgatcacagatcagtagcaaaatacaaattgacaattcaaaattataaataaaactctgttgaggatgtttaactttgagcctccaaatttaagagctaagcttggaagaaacaaatttataggttatatttccctcttaaattaaaaaacaaacttcctctggcagtagnttgtgaattcctttcattgnaatgataccatgattacaggatcaaaaatgcttaacttacttgccattctgctcacatcatcacagttgttt

SEQ ID NO: 743 - DNA, 275 bp, Homo sapien
  misc_feature (1)...(275): n = A,T,C or G
cangacgctacttcccctatcatagaagagcttatcacctttcatgatcacgccctcatagtcattttccttatctgctccctagtcctgtatgcccttttcctaacactcacaacaaaactaactaatactaacatctcagacgctcaggaaatagaaaccgtctgaactatcctgcccgccatcatcctagtcctcatcgccctcccatccctacgcatcctttacataacagacgaggtcaacgatccctcccttaccatcaaatcaattgg

SEQ ID NO: 744 - DNA, 295 bp, Homo sapien
  misc_feature (1)...(295): n = A,T,C or G
ctgtncttttaaaaaatctggatgttttttatttagtgattgttcgacaattagctgcttcaaaacataatgtgcattgcttatgaatgccttcatatactaatacagatactctgataatattacactctaataaggataatgctgaattttgaaaggacacaaaacatctaatgccaatatatacatgattagccaacatctttgctatcaagaccactcgtttttaaataaagatgcaagtgtcagttgtagattattgggatgaagctaaatccccagaatgcagcagcag

SEQ ID NO: 745 - DNA, 477 bp, Homo sapien
  misc_feature (1)...(477): n = A,T,C or G
cgcgttactgtacatattgctagcaggagacaactggaaatactaaacaaatactggaattcacattacagacagacgaaaccaacatggatgccacacataacttcctttgtagtttcacagagagcctatttgtggttgctcaggtggggtcatacattgcttgcagaaatggcctgatcatagctctatgaaacaatgaattcggaatgaaatcttaccatgacacctctctgtaggaaagaaatgttgcttcacgtgtgctaagttgagataataatatttcacatatttatatacagagaatcactctcaaatttaacccaagataagcaataggatttgggggtgacttgtacacatttctaacaacacttttcttttttctagaggtcactctcaaacactgatatatcactatagtttgagtgtanggattcagtaatcaaaggttgttattgcaaaagagccaggcag

SEQ ID NO: 746 - DNA, 524 bp, Homo sapien
  misc_feature (1)...(524): n = A,T,C or G
ctgtgaaattgggttgggagagccaaaatactttacaacttcagaccggagaaaaggccagaggtgtgaagttagactctatgatgaaacagagtcgtcttttgcgatgacatgttgggataatgaatccattctacttgcacagagctggatgccacgagaaacagtaatatttgcctcagatgtaagaataaattttgacaaatttcggaactgcatgacagcaactgtaatctcaaaaaccattattacaactaatccagatataccagaagctaacattctgctgaattttatacgagaaaataaagaaacaaatgttctggatgatgaaattgacagttatttcaaagaatccataaatttaagtacaatagttgatgtctacacagntgaacaattaaagggaaaagctttgaagaatgaaggaaaagctgatccttcctatggcatcctttatgcctacatttccacactcaacattgatgatgaaactcaaaagtagttcgaaatagatgttccag

SEQ ID NO: 747 - DNA, 456 bp, Homo sapien
  misc_feature (1)...(456): n = A,T,C or G
cctcagttcttgattgtggttgacggggcgtcaccatgaaggagcccatttagtataaagcttccaaccttttctcttaatcgtttctttaatcttttaaaccatcttcaagtgcataggggagtttccgatgccagaggatgaaagcaagtgctttctccaccctctcctcccagagtgaaaacaaatccttttgctgatacttgtttcaaaagcatccattgtaaagcttctcagtgacacaaaatactgagaggtaactttttatcaatcaaaccacataccccaatttaacacctttcagtgctctgaattcaactgacagactaaagggtgtttcctgtaacagtctgaaatattaagtgttttttttgttttgtttttaaatcttatttcagaaaacttcctctnggggtaggaaagtacacatgaagcagcaaagtaacgaagaaaaac

SEQ ID NO: 748 - DNA, 474 bp, Homo sapien
  misc_feature (1)...(474): n = A,T,C or G
ccanaccagggaaccaaatgcagacagngaagttctctgcttcttttggctataatgngacaagaaagggatcatcttttgaagatgtttaaagaaataaagcaactttctttataaacagtcaaataatcaattaatggaataaataagtactaacccacattttaaccactctgtaatcactacactttacatattttttatttnggnggcaaantcccccataattagtctaaaatccaccaatcacttttaaaagtaaaatgaatagccaccaaaataagaaaatcttctgttcactctttggctaaaaaggaaaacaaataaaacaaaacaaaaagaaacagaagacaactgtaacactggtgataaaagaaactttttttttacaagtaaaataaagttatcaatttaaatcttggncactttataaaaacaagaggtaatgttgtaataaaacagcagtagcctcag

SEQ ID NO: 749 - DNA, 355 bp, Homo sapien
  misc_feature (1)...(355): n = A,T,C or G
cctgggtnnagnggctgactgnaacctccacttcctgttctcaggcaatcctcctgcctcagcctccttagtagctgggactacaggagtgtgcaaccatgcccaactaatttttgtatttttaatagagacagggtttcaccatgttgatcaggttggtctccaactcctgacctcaggtgatccacctgtcccagcctcccaaagtgctgggattacaggcatgagccaccacgcccggnccaggataaagtaaaaatttgtaagcacacaaggccctttgcaacctggctcctggttactactttaancctcctgccctcccaaatgtnctcactgtttttctanacatacc

SEQ ID NO: 750 - DNA, 493 bp, Homo sapien
  misc_feature (1)...(493): n = A,T,C or G
ccatgctggtctcgaactcctgaactcaggtgatccacccgcctcagtctcccaatagattacatatattattaatgaattgcttcctttaacaccctattcattgaattttccagtaaaccacaattactaattactcctgaaatcagaaaagaggttaaaaagattttataacagtatcctatgaaatctactactttcaagtaatagtagttgaattaccaaaacccgtcactcaagccaatgactacaattaagatatgagtaacatttcctagataaataaagtcaattaattatatttgcatctgggaaatagagaaagtacatataagccatgattttgaagncaaaagagagagantatttgccaaggaggggtgagttatagtatgtaattataacatacagaagctttttgtatgctggtaactaattttaatttcctacattnttatggagatttctgctattcttgtcctattttccacct

SEQ ID NO: 751 - DNA, 364 bp, Homo sapien
  misc_feature (1)...(364): n = A,T,C or G
cgaggtctggnaaggtcaccaagtctgcccaganagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgnggaccactttggttttcttttttgcgtgtggcagttttaagttattagtttttaaaatcagtactttttaatggaaacaacttgaccaaaaatttgtcacagaattttgagacccattaaaaaagttaaatgagataaaaaaaaaaaancntg

SEQ ID NO: 752 - DNA, 498 bp, Homo sapien
  misc_feature (1)...(498): n = A,T,C or G
ctggattatgggttggnattggtcatatgttagactccatacaggcatagctatgatgcagtgaatcccttagaagttacaattctcaaattacatacttcctcagatgtaacattagaactcaatatttctaacaataacataccagaaaaggctggactggcactcatctgctgactaacttgtagcctcagtaatatgacatacttgcctttaacaaattatctcaaattaactaacagaccttcagaaaatggagattctttttgatggggacataatcaaatttaagtctgagaaatatgcttaacagttggaactcaaattaaatgtactgattttaaagtttagacattaacaagtgatanattagcctcaaaaaaagacaatttggnaaggnttaggtcttttaatttggtgcttgntcacaacttgactggtgcttctttccttgctgcttcacatcaagcatggggccaattctattttcagtaaatg

SEQ ID NO: 753 - DNA, 467 bp, Homo sapien
  misc_feature (1)...(467): n = A,T,C or G
nacaaccttagccanaaccatttacccaaataaagggataggcgatagaaattgaaacctggcgcaatagatatagnaccgcaagggaaagatgaaaaattataaccaagcataatatagcaaggactaacccctataccttctgcataatgaattaactagaaataactttgcaaggagagccaaagctaagacccccgaaaccagacgagctatctaagaacagctaaaagagcacacccgtctatgtagcaaaatagtgggaagatttataggtagaggcgacaaacctaccgagcctggtgatagctggntgnccaagatagaatcttagntcaactttaaatttgcccacagaaccctctaaatccccttgtaaatttaactgttagtccaaagaggaacagctcttggacacnaggaaaaaaccttgcagagagagtaaaaaatttaacacccatagtagg

SEQ ID NO: 754 - DNA, 196 bp, Homo sapien
  misc_feature (1)...(196): n = A,T,C or G
gtcatgttcaagtgttntaatctgacgcaggcttatgcggaggagaatgttttcatgttacttatactaacattagttcttctatagggtgatagattggtccaattgggtgtgaggagttcagttatatgtttgggattttttaggcagtgggtgttgagcttgaacgctttcttaattggtggctgcttttagg

SEQ ID NO: 755 - DNA, 381 bp, Homo sapien
ctggaaaggattctgtacatataagacatcaaatattgagggatactggaacttttaaattaatgggcaaagaaagtcaacaaaggaagttcatatgaaatcaaactagtaatatgattacaaaaaaaaagtttaaaatttttcttggccccagtcttatcatttctgagccaaatacaattctatcgaaatcacctgaaactgaaatcaccattctaggctggttttcccataaagatggactgctccaaaaagaggaatcaagaaagaatttggctcacagtgaattattcactttgtcttagttaactaaaaataaaatctgactgttaactacagaaatcatttcaaattctgtggtgataataaagtaatgaccgc

SEQ ID NO: 756 - DNA, 341 bp, Homo sapien
  misc_feature (1)...(341): n = A,T,C or G
ggntataaacctattatttattgcagaactaataaaaaatccaaagccttgtatttgtacatctttattatctctaaagcactttcctcaacctaatttcagtttttacaattggtactcaagaaaatagagacagaaatcatttgattttgcccagaaaccatctgcttatatttataaggccacctaatttgaaatcacatatagaccaggcgcggtggctcacgcctgtaattccaacactttggaaggccaaggcaggtggatcacaaggtcaagagattgagaccatcttggccaacatggcgaaaccccgtctctaccaaaaatacaaaaatcag

SEQ ID NO: 757 - DNA, 479 bp, Homo sapien
  misc_feature (1)...(479): n = A,T,C or G
cgcnttactgtacatattgctagcagggagacaactggaaatactaaacaaatactggaattcacattacagacagacgaaaccaacatggatgccacacataacttcctttgtagtttcacagagagcctatttgtggttgctcaggtggggtcatacattgcttgcagaaatggcctgatcatagctctatgaaacaatgaattcggaatgaaatcttaccatgacacctctctgtaggaaagaaatgttgcttcacgtgtgctaagttgagataataatatttcacatatttatatacagagaatcactctcaaatttaacccaagataagcaataggatttgggggtgacttgtncacatttctaacaacacttttcttttttctagaggtcactctcaaacactgatatatcactatagnttgagngtagggattcaagtaatcaaaggttgttattgcaaaagagccaggcag

SEQ ID NO: 758 - DNA, 267 bp, Homo sapien
  misc_feature (1)...(267): n = A,T,C or G
ccatgnctaggtttatagatagttgggtgggttggtgtaaatgagtgaggcaggagtccgaggaggttagttgtggcaataaaaatgattaaggatactagtataagagatcaggttcgtcctttagtgttgtgtatggctatcatttgttttgaggttagtttgactagtcattgttgggtggtaattagtcggttgttgatgagatatttggaggtggggatcaatagagggggaaatagaatgatcagtactgcggcgggtagg

SEQ ID NO: 759 - DNA, 449 bp, Homo sapien
  misc_feature (1)...(449): n = A,T,C or G
cgaggtcttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcccgacatggagtctgatatacgttcatgggaattgtttctttctaatgttacaaaagaaattgagaaagcaaagtctcagtttgaagaacaaattaaggcaattaaaaatggttcccggctcagtgaactttctaaagngcagatttctgagctttcatttcctgcctgtaacacggttcatcccgagttactccctgagtcttcaggccacgatgg

SEQ ID NO: 760 - DNA, 414 bp, Homo sapien
  misc_feature (1)...(414): n = A,T,C or G
ccatnaactggaagcagctcactaaacaaacagnggcatacccatagaactgcatacttctcagcagtatgaaagaatgagctacttatataagcatcattgataaacctcaaaaaaaaaatgccacatgaagaancccaagggggagaaacataaaaactttatatgncagncatataaaattctagaaaatgcaaactaatccatcntaaaggaaagtaaatcancagttgtctggaggaccanagagagcaggaggagagagattnttaanggggttaaagtaaattngggagtgcccttccatttttaaatnctatgaaaatgaaagtaaaggcccntgcatgttgtaaactaatagtaacaaacagattgggttggagtggggtgttgtctggggacatcattacaaan

SEQ ID NO: 761 - DNA, 428 bp, Homo sapien
gagcctcactaaaataacagatttcagtatagccaagttcatcagaaagactcaaatggaatgatttacaagatagaacactttaaaccaggtcagtcctatctttttgtagctgaaggctatcagtcataacacaatttcgcgtacacctctgctcattatggaattacacttaaaacgaatctcaagagggtgaccattgttgtttcagataccatccctaaggagagtggttaacaggaagattgccagtgttactgatggaaagaagtgtttgtttgttttttttcttgtcaaagacttacaccatagttttaaattaaactgtcaggcattttctcagacaggttttccttttcaatgcagtaatgaagaactaagataaaaatcatgacttttgactgccactcaacattattacatgcacc

SEQ ID NO: 762 - DNA, 574 bp, Homo sapien
  misc_feature (1)...(574): n = A,T,C or G
caggtctgaactgataagtattaagagacgtttgttgctagttaagngttccagttgagagttcgaagtgaaaacctgggctctttaccagtgttgagtgagaagatttatttctctttcctctgaatttaccacatgtaacatcacagagacatgtagagttcctttaggatttgcgatttgaaccagnccagtctgattttcaggtgaattctgtgaagagcttgatgggggaagtctgaagacagaaggaattagggaaaagggtgatacttacagagtaaaggaaataaatgaaaagataatggtatttttggtagccacagggaaatagcaggaggggactggagatcacacacacgcacacgcacacacacaaacacacacacacgctaaaactcaaactaaaaacctcccaaaggagctgctttgtttgcagacttcaattngaagtagatactaagggcaagaatagaccagttaaaattcacctgaaaatctcttcccanncttcaaatgtgctaaaatatcactgtcagcttagcatctctncatgtatgtatatatagatgta

SEQ ID NO: 763 - DNA, 465 bp, Homo sapien
  misc_feature (1)...(465): n = A,T,C or G
cctactatgggtgttaaaattttttactctctctacaaggntttttcctagtgtccaaagagctgttcctctttggactaacagttaaatttacaaggggatttagagggttctgngggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggatataatttttcatctttcccttgcggtactatatctattgcgccangtttcaatttctatcgcctatactttatttgggtaaatggtttggctaaggttg

SEQ ID NO: 764 - DNA, 151 bp, Homo sapien
ctgtcaattaatgctagtcctcaggatttaaaaaataatcttaactcaaagtccaatgcaaaaacattaagttggtaattactcttgatcttgaattacttccgttacgaaagtccttcacatttttcaaactaagctactatatttaagg

SEQ ID NO: 765 - DNA, 251 bp, Homo sapien
gaagagcttatcacctttcatgatcacgccctcatagtcattttccttatctgcttcctagtcctgtatgcccttttcctaacactcacaacaaaactaactaatactaacatctcagacgctcaggaaatagtaaccgtctgaactatcctgcccgccatcatcctagtcctcatcgccctcccatccctacgcatcctttacataacagacgaggtcaacgatccctcccttaccatcaaatcaattgg

SEQ ID NO: 766 - DNA, 375 bp, Homo sapien
  misc_feature (1)...(375): n = A,T,C or G
cgaggtctgncctcctggttcttcatccattattaacagaagagcatactggtttcggtccataaaatctttgggaagggacaactgtaaaggaagttcatagtcgtcaatatgaaggattttaatttctggctttcctatcttcttcttcaggatagcttccttcagcatagaattgttttccaatataaaatattttgctgggttgtccgtactatgtaggctgaccactgggacccttggaccttcacagaataataagaaatgttgattcatgggactaaaactggcatcaaaatatgtacattgttctttcatgaaattacatgaaatgcattggcgattcaataatccttcagtagaagcactgtacag

SEQ ID NO: 767 - DNA, 485 bp, Homo sapien
  misc_feature (1)...(485): n = A,T,C or G
cgaggtctgaaccctcgtggagccattcatacaggtccctaattaaggaacaagtgattatgctaccttngcacggttagggtaccgcggcccgttaaacatgtgtcactgggcaggcggtgcctctaatactggtgatgctagaggtgatgtttttggnaaacaggcggggtaagatttgccgagttccttttactttttttaacctttccttatgagcatgcctgtgttgggttgacagtgagggtaataatgacttgttggtgattgtagatattgggctgttaattgtcagttcagtgttttaatctgacgcaggcttatgcggaggagaatgttttcatgttacttatactaacattagttcttctatagggtgatagatnggtccaattgggtgtgaggagntcacttatatgtttgggattttttaggtaagngggtgttgagcttgaacgctttcttaattgggggctgcttttang

SEQ ID NO: 768 - DNA, 379 bp, Homo sapien
  misc_feature (1)...(379): n = A,T,C or G
ctgatattctattaaagatacaaagaggagctggnaccatttcttctgaaactattacaaacaactgaaaaggtggaatttctccctaattcattttaggaggccagcattatactgataccaaaacctggcagaggtacaataataaaaggaaacttcaagtcagtatcactgatgaacaccaatgtgaaaatcctcaataaaatactggcaaactgaattcagcagcacatcaaaaagctaatccaccacaatcaagtcagcttcatccctgcgatgcaagtctggttcaacatatgcaaatcaataaatacaattcatcagataaacagagctaaagacaaaattcacatgattttctcaatagatgcagaaaagg

SEQ ID NO: 769 - DNA, 518 bp, Homo sapien
  misc_feature (1)...(518): n = A,T,C or G
cgaggtccatatgatgatcagtctatatagtttaaggcgcagatacacaaattttcaaaaatatgggtagaatatagtcaatatgaatggaatagacaatgctttgaaaatcactggagggaggctttattgtttgtgaaaacatgttgtcatcactttttgctttaagcccttggtggtgaaataactcaaaccattcttccttatgctgaagatcgagaaccccaagtatcacatctaccatcccactcatcaatgtgattggtcagtctttgctgaggncctgcatagccagttttaaagttagagttcttgcatatacatatgaaaaggcatgttacttgtgctttcaaagagctttttgcttggtgtaaaaagaaaactcaaattacagtgtgatgtggaatataatggtggtagtttcatcgagatgatgggaaagaattgataagataaagcngaaagatgagcagaattttcagattgggtntggaaagagcacttaagaaagagggtgg

SEQ ID NO: 770 - DNA, 378 bp, Homo sapien
  misc_feature (1)...(378): n = A,T,C or G
tatgggtcctgagtgtggaatataagataacaagacaattcccttgctttcaagggaaatcacactttataaaactttgaattcttgaaatgggtttcagaggttccaaggtcaaattcaagaataagagttaagaagaaaaagactatgagaaaggaagtgntgaccccatttgcatttaaatggcaggaatagtctcaatctactcattggggaaaaatgtatgttgcatatttttgagatattgcaacttgctctctctctttgccaccccaccctttgncatgctctgtttttgggctgaattggcaagaaaaatggctggagggctggaagaagntggacccttcttccttcttccttcttccttctttctcc

SEQ ID NO: 771 - DNA, 207 bp, Homo sapien
cataaatattatactagcatttaccatctcacttctaggaatactagtatatcgctcacacctcatatcctccctactatgcctagaaggaataatactatcactgttcattatagctactctcataaccctcaacacccactccctcttagccaatattgtgcctattgccatactagtctttgccgcctgcgaagcagcggtagg

SEQ ID NO: 772 - DNA, 384 bp, Homo sapien
  misc_feature (1)...(384): n = A,T,C or G
cctactatgggtgttaaattttttactctctctacaaggttttttcctagtgtccaaagagctgttcctctttggactaacagttaaatttacaaggggatttagagggttctgngggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttccc

SEQ ID NO: 773 - DNA, 182 bp, Homo sapien
cccttttcctaacactcacaacaaaactaactaatactaacatctcagacgctcagggaaatagaaaccgtctgaactatcctgcccgccatcatcctagtcctcatcgccctcccatccctacgcatcctttacataacagacgaggtcaacgatccctcccttaccatcaaatcaattgg

SEQ ID NO: 774 - DNA, 191 bp, Homo sapien
ccatggctaggtttatagatagttgggtggttgggtgtaaatgagtgaggcaggagtccgaggaggttagttgtggcaataaaaatgattaaggatactagtataagagatcaggttcgtcctttagtgttgtgtatggctatcatttgttttgaggttagtttgattagtcattgttgggtggtaattag

SEQ ID NO: 775 - DNA, 192 bp, Homo sapien
  misc_feature (1)...(192): n = A,T,C or G
ccatggctaagntatatagatagctgggtggctggagtaaatgantgaggnacgagtccgangaggttagttgaggcaataaaaatgatnaaggatactagtataagagatcangttcgtcctttacatgttgngtatggctatcatttgttttgaggctagnttgattagtcattgttgggtggtaattaa

SEQ ID NO: 776 - DNA, 144 bp, Homo sapien
ctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaa

SEQ ID NO: 777 - DNA, 483 bp, Homo sapien
  misc_feature (1)...(483): n = A,T,C or G
cctactatgggtgntaaattttttactctctctacaaggttttttcctagtgtccaaagagctgttcctctttggactaacagttaagtttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggntaagtccttgctatattatgcttggatataatttttcatctttcccttgcggtactatatctattgcgccaggtttcaatttctgccgcctatactttatttgggtaaatggtttggctaangttgctggtagaaggtggagtg

SEQ ID NO: 778 - DNA, 393 bp, Homo sapien
  misc_feature (1)...(393): n = A,T,C or G
ctgcatttttattgcgatctgcagatgaactgggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagngngtcaccataaatatcaggggcataaaaggctatctattcttaattcaaggataaaacagaagaagcttgtggnataaaacaatagtcaagatccag

SEQ ID NO: 779 - DNA, 277 bp, Homo sapien
  misc_feature (1)...(277): n = A,T,C or G
cctnttgatttgatgggtaaggggagggatcgttgacctcgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactatgagggcgtgatcatgaaaggtgataagctcttctatgataggggaagtagcgtcttg

SEQ ID NO: 780 - DNA, 328 bp, Homo sapien
  misc_feature (1)...(328): n = A,T,C or G
catgntatggataaccatnttaactgtattttntgcancccgtaccttcttgggaatacaattgtctaactttttatttttggnctggctgttgtggtgtgcaaaactccgtacattgctattttgccacactgcaacaccttacagatgtggaagatgtgaaatttgtcatcaattatgactaccctaactcctcagaggattatattcatcgaattggaagaactgctcgcagtaccaaaacaggcacagcatacactttctttacacctaataacataaagcaggggagcgaccttatctctgtgcttcgggaagctaancaaac

SEQ ID NO: 781 - DNA, 305 bp, Homo sapien
  misc_feature (1)...(305): n = A,T,C or G
ctgttcagaaagctcattggacctggttttgaaaataaaacaaagttaaaaccctgggaggagttattgtgcagngtggagtactcaggctttcttataaagaaaaaaaaagttatctggtaccaaagtgtgcaacctacagaccctcaggtactgccctgtgacttctctgtatgacatcacaaggctgccaagtgcctgtttttctagaactaggagttggtgaggtttggctantgctgaaaccatgcataggattggtttactaaattaaaaccttattacgtacgtcctccaaaagacag

SEQ ID NO: 782 - DNA, 497 bp, Homo sapien
  misc_feature (1)...(497): n = A,T,C or G
cgaggtggctttaattgatgttaatgccttatgtcaaatgtaaagttagaatttgctagggctgggatagggagtgatatttctaggacttagacattgaaaactaattcagcctgtagtaacctggatggttttcaatggcatggttagtcaaattcatggttttaaacttagaagcagctttcgggggagagggtaggttggagcatttattacatattttactgtttaatgtcttaaccgtgggccttttaatttgtaaacactgaaatgattgttgggctgtggaaaacatttacctatttaccttggaagttttaaaagacagtccactttttagcatgtgtgttgcgtccagcctgtggtcgtcttaactaataaatgngatttttctctcaaaaaaaaaacctccccgggcggccgctcaagggcnaattccncacactggcggccgttactaggggatccganctcggtccaagcttggcgtaatcatg

SEQ ID NO: 783 - protein, 364 aa, Homo sapien
MWQPLFFKWLLSCCPGSSQIAAAASTQPEDDINTQRKKSQEKMREVTDSPGRPRELTIPQTSSHGANRFVPKSKALEAVKLAIEAGFHHIDSAHVYNNEEQVGLAIRSKIADGSVKREDIFYTSKLWSNSHRPELVRPALERSLKNLQLDYVDLYLIHFPVSVKPGEEVIPKDENGKILFDTVDLCATWEAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 784 - DNA, 6353 bp, Homo sapien
tggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctagaaataattttgtttaactttaagaaggagatatacatatgcagcatcaccaccatcaccactggcagcccctcttcttcaagtggctcttgtcctgttgccctgggagttctcaaattgctgcagcagcctccacccagcctgaggatgacatcaatacacagaggaagaagagtcaggaaaagatgagagaagttacagactctcctgggcgaccccgagagcttaccattcctcagacttcttcacatggtgctaacagatttgttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaatgactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggat

SEQ ID NO: 785 - DNA, 5502 bp, Homo sapien
tggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctagaaataattttgtttaactttaagaaggagatatacatatgcagcatcaccaccatcaccactggcagcccctcttcttcaagtggctcttgtcctgttgccctgggagttctcaaattgctgcagcagcctccacccagcctgaggatgacatcaatacacagaggaagaagagtcaggaaaagatgagagaagttacagactctcctgggcgaccccgagagcttaccattcctcagacttcttcacatggtgctaacagatttgtttgatgaattctgcagatatccatcacactggcggccgctcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggat

SEQ ID NO: 786 - protein, 108 aa, Homo sapiens
RRSCEPATRVPEVWILSPLLRHGGHTQTQNHTASPRSPVMESPKKKNQQLKVGILHLGSRQKKIRIQLRSQVLGREMRDMEGDLQELHQSNTGDKSGFGFRRQGEDNT

SEQ ID NO: 787 - protein, 152 aa, Homo sapiens
RPKEEVPRSKALEVTKLAIEAGFRHIDSAHLYNNEEQVGLAIRSKIADGSVKREDIFYTSKLWSTFHRPELVRPALENSLKKAQLDYVDLYLIHSPMSLKPGEELSPTDENGKVIFDIVDLCTTWEAMEKCKDAGLAKSIGVSNFNPQAAGD

SEQ ID NO: 788 - DNA, 1633 bp, Homo sapiens; identical to SEQ ID NO: 316

SEQ ID NO: 789 - protein, 200 aa, Homo sapien
MAKGDPKKPKGKMSAYAFFVQTCREEHKKKNPEVPVNFAEFSKKCSERWKTMSGKEKSKFDEMAKADKVRYDREMKDYGPAKGGKKKKDPNAPKRPPSGFFLFCSEFRPKIKSTNPGISIGDVAKKLGEMWNNLNDSEKQPYITKAAKLKEKYEKDVADYKSKGKFDGAKGPAKVARKKVEEEDEEEEEEEEEEEEEEDE

What is claimed is:

1. An isolated polypeptide comprising the amino acid sequence of SEQ ID NO:786.

2. A composition comprising a polypeptide of any one of claims 1 and a physiologically acceptable carrier.

3. A composition comprising a polypeptide of any one of claims 1 and a non-specific immune response enhancer.

* * * * *

UNITED STATES PATENT AND TRADEMARK OFFICE
CERTIFICATE OF CORRECTION

PATENT NO. : 6,933,363 B1
DATED : August 23, 2005
INVENTOR(S) : Tongtong Wang et al.

It is certified that error appears in the above-identified patent and that said Letters Patent is hereby corrected as shown below:

Column 59,
Lines 59-60, "any one of claims" should read as -- claim --.

Column 60,
Lines 56-57, "any one of claims" should read as -- claim --.

Signed and Sealed this

First Day of November, 2005

JON W. DUDAS
*Director of the United States Patent and Trademark Office*